United States Patent
Van Wyk

(10) Patent No.: US 10,131,910 B2
(45) Date of Patent: Nov. 20, 2018

(54) ANTISENSE OLIGONUCLEOTIDES FOR THE TREATMENT OF USHER SYNDROME TYPE 2

(71) Applicant: STICHTING KATHOLIEKE UNIVERSITEIT, Nijmegen (NL)

(72) Inventor: Hendrikus Antonius Rudolfus Van Wyk, Nijmegen (NL)

(73) Assignee: STICHTING KATHOLIEKE UNIVERSITEIT, Nijmegen (NL)

( * ) Notice: Subject to any disclaimer, the term of this patent is extended or adjusted under 35 U.S.C. 154(b) by 0 days.

(21) Appl. No.: 15/324,572

(22) PCT Filed: Jul. 9, 2015

(86) PCT No.: PCT/EP2015/065736
§ 371 (c)(1),
(2) Date: Jan. 6, 2017

(87) PCT Pub. No.: WO2016/005514
PCT Pub. Date: Jan. 14, 2016

(65) Prior Publication Data
US 2017/0159052 A1   Jun. 8, 2017

(30) Foreign Application Priority Data
Jul. 10, 2014   (EP) .................................... 14176438

(51) Int. Cl.
*C12N 15/113* (2010.01)

(52) U.S. Cl.
CPC ........ *C12N 15/113* (2013.01); *C12N 2310/11* (2013.01); *C12N 2310/315* (2013.01); *C12N 2310/321* (2013.01); *C12N 2320/33* (2013.01)

(58) Field of Classification Search
CPC .......................... C12N 15/113; C12N 2320/33
See application file for complete search history.

(56) References Cited

U.S. PATENT DOCUMENTS

| 7,592,443 | B2 * | 9/2009 | Khvorova | ............. | C12N 15/111 536/24.5 |
| 2001/0053519 | A1 * | 12/2001 | Fodor | ................. | B01J 19/0046 435/6.11 |
| 2005/0106731 | A1 * | 5/2005 | Davidson | ............. | C12N 15/113 435/456 |
| 2013/0129668 | A1 * | 5/2013 | Firestein | ............. | C12Q 1/6883 424/85.1 |

FOREIGN PATENT DOCUMENTS

| WO | 200125486 A1 | 4/2001 | |
| WO | 2012151324 A1 | 11/2012 | |
| WO | WO-2014022739 A2 * | 2/2014 | ............. C07H 21/02 |

OTHER PUBLICATIONS

Random Primer 24, sold by New England Biolabs (see p. 121 of the 1998/99 New England Biolabs Catalog). (Year: 1998).*
International Search Report for PCT/EP2015/065736.
Gorman et al., "Stable alteration of pre-mRNA splicing patterns by modified U7 small nuclear RNAs"; XP-002642571 (Apr. 1998); Proc. Natl. Acad. Sci. USA; vol. 95; Biochemistry; pp. 4929-4934.
Lenassi et al., "The effect of the common c.2299delG mutation in USH2A on RNA Splicing"; Elsevier (2014); Experimental Eye Research; 122: pp. 9-12.
McGee et al., "Novel mutations in the long isoform of the USH2A gene in patients with Usher syndrome type II or non-syndromic retinitis pigmentosa"; NIH Public Access (Jul. 2010); J. Med. Genet.; 47(7): pp. 499-506.
Mitrpant et al., "Improved Antisense Oligonucleotide Design to Suppress Aberrant SMN2 Gene Transcript Processing: Towards a Treatment for Spinal Muscular Atrophy"; XP-002733112 (Apr. 2013); PLOS ONE; Public Library of Science; vol. 8; Issue 4; e62114.
Vaché et al., "Usher syndrome type 2 caused by activation of an USH2A pseudoexon: implications for diagnosis and therapy"; Wiley Periodicals, Inc.; Human Genome Variation Society (2011); vol. 33 (1); pp. 104-108.
van Wijk, et al., "Identification of 51 novel exons of the Usher syndrome type 2A (USH2A) gene that encode multiple conserved functional domains and that are mutated in patients with Usher syndrome type II"; Am. J. Hum. Genet. (2004); 74: pp. 738-744.
XP002744859; Sequence 63854 from Patent WO2012149438; retrieved from EBI accession No. EM_PAT:JA980903; Database accession No. JA980903 sequence.
XP-002744860; Sequence 47894 from Patent WO2012149438; retrieved from EBI accession No. EM PAT:JA964943; Database accession No. JA964943 sequence.

\* cited by examiner

*Primary Examiner* — J. E. Angell
(74) *Attorney, Agent, or Firm* — Volpe and Koenig, P.C.

(57) ABSTRACT

The invention relates to the fields of medicine and immunology. In particular, it relates to novel antisense oligonucleotides that may be used in the treatment, prevention and/or delay of Usher syndrome type 2A and/or USH2A-associated non syndromic retina degeneration.

Figures 1C, 2A:
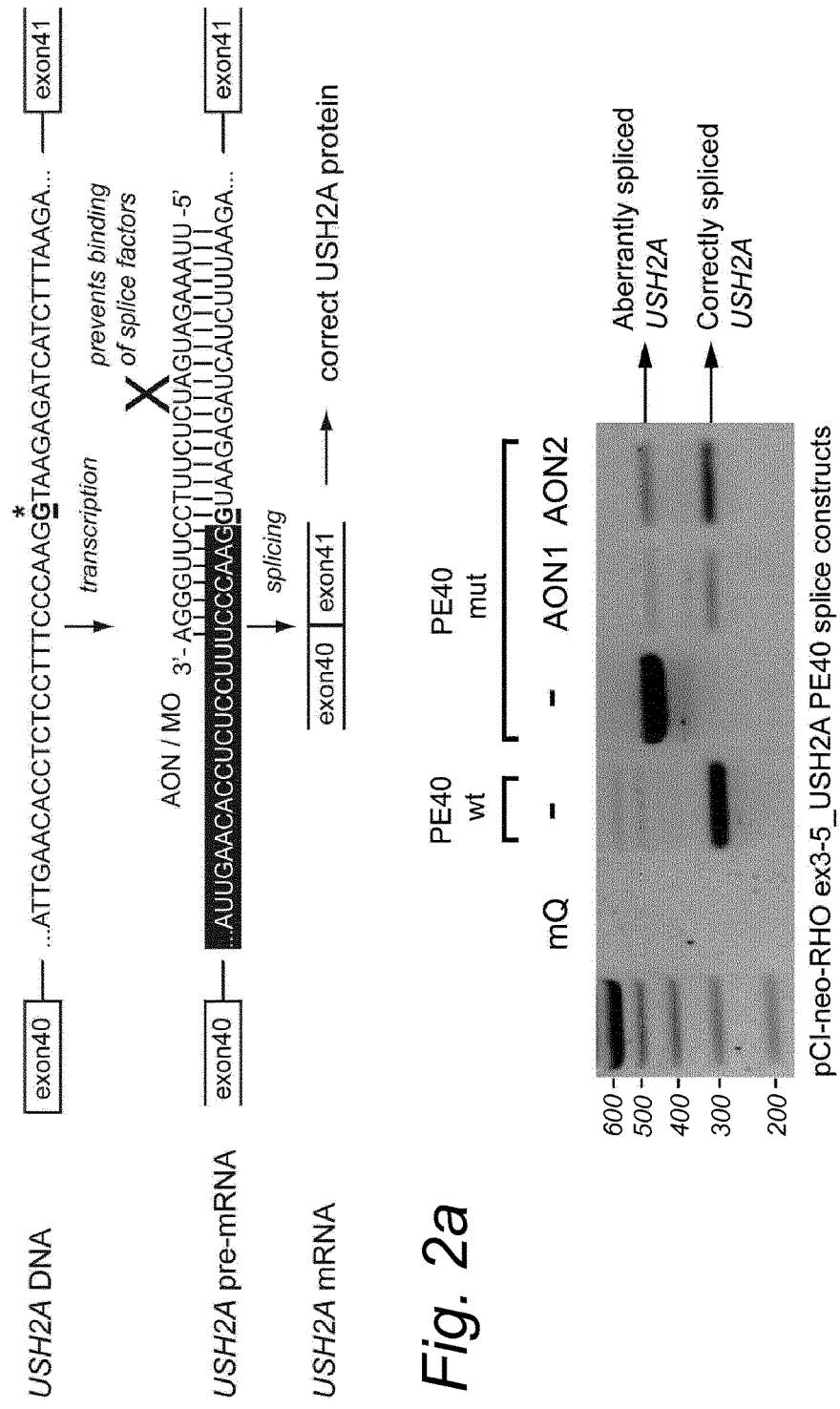

7 Claims, 9 Drawing Sheets
Specification includes a Sequence Listing.

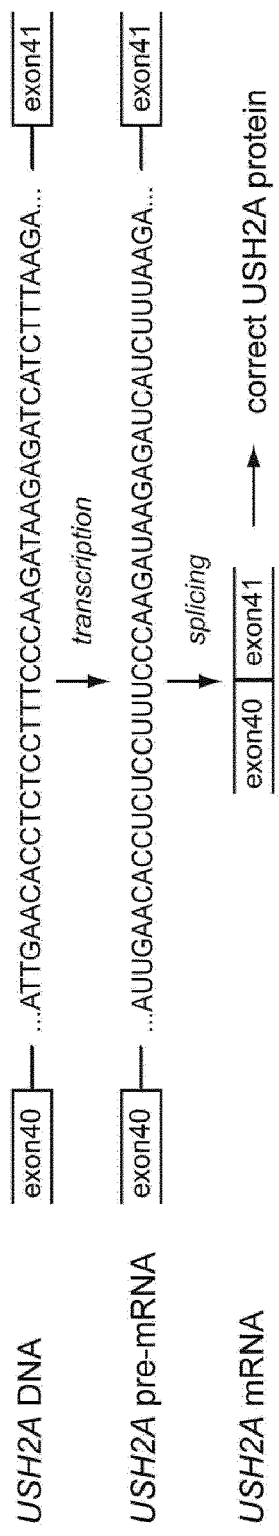
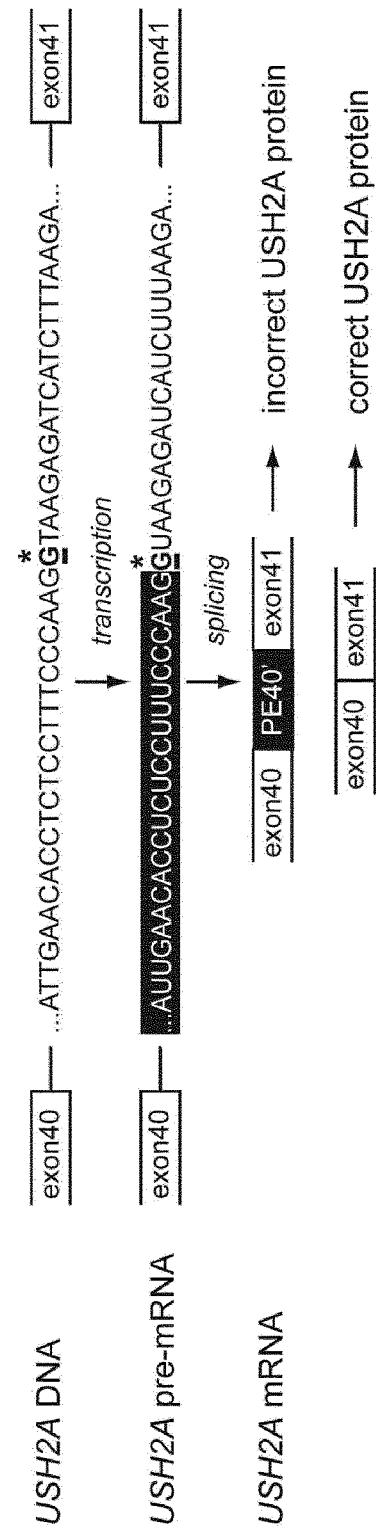
Fig. 1a
Fig. 1b

ANTISENSE OLIGONUCLEOTIDES FOR THE TREATMENT OF USHER SYNDROME TYPE 2

CROSS REFERENCE TO RELATED APPLICATION

This application is a 35 U.S.C. § 371 national phase application of PCT/EP2015/065736, which was filed Jul. 9, 2015, and claims the benefit of European patent application No. 14176438.1 filed Jul. 10, 2014, both of which are incorporated herein by reference as if fully set forth.

The sequence listing filed with this application, titled "Sequence Listing," having a file size of 2,289,787 bytes, and created Jul. 9, 2015 is incorporated herein by reference as if fully set forth.

FIELD OF THE INVENTION

The invention relates to the fields of medicine and immunology. In particular, it relates to novel antisense oligonucleotides that may be used in the treatment, prevention and/or delay of Usher syndrome type 2A and/or USH2A-associated non syndromic retina degeneration.

BACKGROUND OF THE INVENTION

Usher syndrome (USH) and non-syndromic retinitis pigmentosa (NSRP) are degenerative diseases of the retina. USH is clinically and genetically heterogeneous and by far the most common type of inherited deaf-blindness in man (1 in 6,000 individuals)(Kimberling et al, 2010). The hearing impairment in USH patients is mostly stable and congenital and can be partly compensated by hearing aids or cochlear implants. NSRP is more prevalent than USH, occurring in 1 per 4,000 individuals (Hartong et al, 2006). The degeneration of photoreceptor cells in USH and NSRP is progressive and often leads to complete blindness between the third and fourth decade of life, thereby leaving time for therapeutic intervention. Mutations in the USH2A gene are the most frequent cause of USH explaining up to 50% of all USH patients worldwide (±1300 patients in The Netherlands) and, as indicated by McGee et al (2010), also the most prevalent cause of NSRP in the USA (likely accounting for 12-25% of all cases of retinitis pigmentosa (RP); ±600 patients in The Netherlands). They are spread throughout the 72 USH2A exons and their flanking intronic sequences, and consist of nonsense and missense mutations, deletions, duplications, large rearrangements, and splicing variants (USHbases and unpublished results). The by far most frequently mutated exon is exon 13, which contains two founder mutations (c.2299delG (p.E767SfsX21) in USH2 patients and c.2276G>T (p.C759F) in NSRP patients). For exon 50, fifteen pathogenic mutations have been reported, of which at least eight are clearly protein truncating (Baux et al, 2007 & 2014; Garcia-Garcia et al, 2011; Dreyer et al, 2008; McGee et al, 2010; Le Quesne Stabej et al, 2012). Recently the first deep-intronic mutation in intron 40 of USH2A (c.7595-2144A>G) was reported (Vaché et al, 2012). This mutation creates a cryptic high-quality splice donor site in intron 40 resulting in the inclusion of an aberrant exon of 152 bp in the mutant USH2A mRNA, and inserts a premature stop codon in exon 41 when translated (FIGS. 1A and B). USH and other retinal dystrophies, for long have been considered as uncurable disorders. Recent and ongoing phase I/II clinical trials using gene augmentation therapy have led to promising results in selected groups of LCA/RP/USH patients with mutations in the RPE65 (Bainbridge et al, 2008; Cideciyan et al, 2008; Hauswirth et al, 2008; Maguire et al, 2008) and MYO7A (Hashimoto et al, 2007; Lopes et al, 2013; Colella et al, 2014; Zallocchi et al, 2014) genes. The size of the coding sequence (15,606 bp) and alternative splicing of the USH2A gene and mRNA, respectively, hamper gene augmentation therapy, due to the currently limiting cargo size of many available vectors (e.g. adeno-associated (AAV) and lentiviral vectors). Despite the broad clinical potential of antisense oligonucleotide (AON)-based therapy, it is not frequently used in the vertebrate eye. AONs are small (16-25 nucleotide) polynucleotide molecules that are able to interfere with splicing as their sequence is complementary to that of target pre-mRNA molecules. Upon binding of an AON, the targeted region of the pre-mRNA is no longer available for splicing factors which results in skipping of the exon that is targeted by the AON. Therapeutically, this methodology can be used in two ways: a) to redirect normal splicing of genes in which mutations activate cryptic splice sites and b) to skip exons that carry (protein-truncating) mutations in such a way, that the reading frame of the mRNA remains intact and a (partially) functional protein is made. For the USH2A gene 28 out of the 72 described exons can potentially be skipped without disturbing the overall reading frame of the transcript. Both methods are already successfully applied in patients with severe genetic disorders (Scaffidi et al, 2005; Cirak et al, 2011a/b; Goemans et al, 2011). It is therefore an objective of the invention to provide a convenient therapeutic strategy for the prevention, treatment or delay of USH and/or NSRP caused by mutations in exons 13, 50 and intron 40 of USH2A. To date however, treatment options available for Usher syndrome patients are limited to ear implants or hearing aids. No treatment for Usher syndrome related blindness is currently available.

DETAILED DESCRIPTION

Surprisingly, it has now been demonstrated that specific antisense oligonucleotides (AONs) are able to block the aberrant splicing of USH2A that is caused by the intronic c.7595-2144A>G mutation leading to the inclusion of pseudoexon 40 (PE40), the inclusion of aberrant exon 13 or the inclusion of aberrant exon 50.

Accordingly, in a first aspect the invention provides an exon skipping molecule or an exon 12 retention molecule that binds to and/or is complementary to a polynucleotide with the nucleotide sequence as shown SEQ ID NO: 8, preferably selected from the group consisting of SEQ ID NO: 12, SEQ ID NO: 13 and SEQ ID NO: 14, more preferably selected from the group consisting of SEQ ID NO: 19, SEQ ID NO: 20, SEQ ID NO: 21, SEQ ID NO: 22, SEQ ID NO: 23 and SEQ ID NO: 24, most preferably selected from the group consisting of SEQ ID NO: 26, SEQ ID NO: 27, SEQ ID NO: 28, SEQ ID NO: 29, SEQ ID NO: 30, SEQ ID NO: 31, SEQ ID NO: 40 and SEQ ID NO: 41 or a part thereof.

In all embodiments of the invention, the terms "modulating splicing" and "exon skipping" are synonymous. In respect of USH2A, "modulating splicing" or "exon skipping" are to be construed as the exclusion of the aberrant 152 nucleotide pseudoexon (SEQ ID NO: 5), the exclusion of aberrant exon 13 or the exclusion of aberrant exon 50 in the USH2A mRNA, or restoring of the reading frame of the mRNA which includes the pseudoexon. In addition, there is provided for the retention of exon 12, preferably when exon 13 is skipped.

For the purpose of the invention the terms "the inclusion of aberrant pseudoexon", "the inclusion of aberrant pseudoexon 40" or "the inclusion of aberrant 152 bp nucleotide pseudoexon" are considered to be synonymous, and considered to mean the inclusion of pseudoexon 40 of the USH2A gene (SEQ ID NO: 5) into the mRNA, or the inclusion of a part thereof or a sequence comprising 90, 91, 92, 93, 94, 95, 96, 97, 98, 99 or 100% of SEQ ID NO:5 into the USH2A mRNA.

For the purpose of the invention the terms "aberrant exon 13" or "aberrant USH2A exon 13" are considered to be synonymous, and considered to mean the presence of a mutation in exon 13 (SEQ ID NO: 32) of the USH2A gene, resulting in an USH2A mRNA with at least one substitution, deletion or insertion in exon 13 of USH2A (SEQ ID NO: 32)

For the purpose of the invention the term "aberrant exon 50" or "aberrant USH2A exon 50" are considered to be synonymous, and considered to mean the presence of a mutation in exon 50 (SEQ ID NO: 33) of the USH2A gene, resulting in in an USH2A mRNA with at least one substitution, deletion or insertion in exon 50 of USH2A (SEQ ID NO: 33)

The term exon skipping is herein defined as inducing, producing or increasing production within a cell of a mature mRNA that does not contain a particular exon that would be present in the mature mRNA without exon skipping. Exon skipping is achieved by providing a cell expressing the pre-mRNA of said mature mRNA with a molecule capable of interfering with sequences such as, for example, the (cryptic) splice donor or (cryptic) splice acceptor sequence required for allowing the enzymatic process of splicing, or with a molecule that is capable of interfering with an exon inclusion signal required for recognition of a stretch of nucleotides as an exon to be included in the mature mRNA; such molecules are herein referred to as exon skipping molecules. The term pre-mRNA refers to a non-processed or partly processed precursor mRNA that is synthesized from a DNA template of a cell by transcription, such as in the nucleus.

The term exon retention is herein defined as inducing, producing or increasing production within a cell of a mature mRNA that does retain a particular exon that should be present in the mature mRNA without exon skipping. Exon retention is achieved by providing a cell expressing the pre-mRNA of said mature mRNA with a molecule capable of interfering with sequences such as, for example, the intronic splice silencer sites in intron 12; such molecule is herein referred to as an exon retention molecule.

The term "antisense oligonucleotide" is understood to refer to a nucleotide sequence which is substantially complementary to a target nucleotide sequence in a pre-mRNA molecule, hnRNA (heterogenous nuclear RNA) or mRNA molecule. The degree of complementarity (or substantial complementarity) of the antisense sequence is preferably such that a molecule comprising the antisense sequence can form a stable hybrid with the target nucleotide sequence in the RNA molecule under physiological conditions.

The terms "antisense oligonucleotide" and "oligonucleotide" are used interchangeably herein and are understood to refer to an oligonucleotide comprising an antisense sequence.

In an embodiment, an exon skipping molecule or an exon 12 retention molecule as defined herein can be a compound molecule that binds and/or is complementary to the specified sequence, or a protein such as an RNA-binding protein or a non-natural zinc-finger protein that has been modified to be able to bind to the indicated nucleotide sequence on a RNA molecule. Methods for screening compound molecules that bind specific nucleotide sequences are, for example, disclosed in PCT/NL01/00697 and U.S. Pat. No. 6,875,736, which are herein incorporated by reference. Methods for designing RNA-binding Zincfinger proteins that bind specific nucleotide sequences are disclosed by Friesen and Darby, Nature Structural Biology 5: 543-546 (1998) which is herein incorporated by reference. Binding to one of the specified SEQ ID NO: 8, 12, 13, 14, 19, 20, 21, 22, 23, 24, 26, 27, 28, 29, 30, 31, 40 and 41 sequences, preferably in the context of the aberrant 152 nucleotide USH2A pseudoexon (SEQ ID NO: 5), the aberrant USH2A exon 13, the aberrant USH2A exon 50 or exon 12 may be assessed via techniques known to the skilled person. A preferred technique is gel mobility shift assay as described in EP 1 619 249. In a preferred embodiment, an exon skipping molecule or exon 12 retention molecule is said to bind to one of the specified sequences as soon as a binding of said molecule to a labeled sequence SEQ ID NO: 8, 12, 13, 14, 19, 20, 21, 22, 23, 24, 26, 27, 28, 29, 30, 31, 40 and 41 is detectable in a gel mobility shift assay.

In all embodiments of the invention, an exon skipping molecule or exon retention molecule is preferably a nucleic acid molecule, preferably an oligonucleotide. Preferably, an exon skipping molecule according to the invention is a nucleic acid molecule, preferably an oligonucleotide, which is complementary or substantially complementary to a nucleotide sequence as shown in SEQ ID NO: 8, or preferably selected from the group consisting of SEQ ID NO: 12, SEQ ID NO: 13 and SEQ ID NO: 14, or more preferably selected from the group consisting of SEQ ID NO: 19, SEQ ID NO: 20, SEQ ID NO: 21, SEQ ID NO: 22, SEQ ID NO: 23 and SEQ ID NO: 24 sequences, or most preferably selected from the group consisting of SEQ ID NO: 26, SEQ ID NO: 27, SEQ ID NO: 28, SEQ ID NO: 29, SEQ ID NO: 30 and SEQ ID NO: 31, or a part thereof as later defined herein. Preferably, an exon 12 retention molecule according to the invention is a nucleic acid molecule, preferably an oligonucleotide, which is complementary or substantially complementary to a nucleotide sequence as shown in SEQ ID NO: 40 or more preferably SEQ ID NO: 41, or a part thereof as later defined herein.

The term "substantially complementary" used in the context of the invention indicates that some mismatches in the antisense sequence are allowed as long as the functionality, i.e. inducing skipping of the 152 nucleotide USH2A pseudoexon (SEQ ID NO: 5), the aberrant USH2A exon 13 or the aberrant USH2A exon 50, or retention of exon 12 is still acceptable. Preferably, the complementarity is from 90% to 100%. In general this allows for 1 or 2 mismatch(es) in an oligonucleotide of 20 nucleotides or 1, 2, 3 or 4 mismatches in an oligonucleotide of 40 nucleotides, or 1, 2, 3, 4, 5 or 6 mismatches in an oligonucleotide of 60 nucleotides, etc.

The invention provides a method for designing an exon skipping molecule or an exon retention molecule, preferably an oligonucleotide able to induce skipping of the aberrant 152 nucleotide USH2A pseudoexon (SEQ ID NO: 5), the aberrant USH2A exon 13 or the aberrant USH2A exon 50, or able to induce retention of exon 12. First, said oligonucleotide is selected to bind to one of SEQ ID NO: 8, 12, 13, 14, 19, 20, 21, 22, 23, 24, 26, 27, 28, 29, 30, 31, 40 and 41 or a part thereof as defined later herein. Subsequently, in a preferred method at least one of the following aspects has to be taken into account for designing, improving said exon skipping molecule any further:

The exon skipping molecule preferably does not contain a CpG or a stretch of CpG, The exon skipping molecule has acceptable RNA binding kinetics and/or thermodynamic properties.

The presence of a CpG or a stretch of CpG in an oligonucleotide is usually associated with an increased immunogenicity of said oligonucleotide (Dorn and Kippenberger, 2008). This increased immunogenicity is undesired since it may induce damage of the tissue to be treated, i.e. the eye. Immunogenicity may be assessed in an animal model by assessing the presence of CD4+ and/or CD8+ cells and/or inflammatory mononucleocyte infiltration. Immunogenicity may also be assessed in blood of an animal or of a human being treated with an oligonucleotide of the invention by detecting the presence of a neutralizing antibody and/or an antibody recognizing said oligonucleotide using a standard immunoassay known to the skilled person. An inflammatory reaction, type I-like interferon production, IL-12 production and/or an increase in immunogenicity may be assessed by detecting the presence or an increasing amount of a neutralizing antibody or an antibody recognizing said oligonucleotide using a standard immunoassay.

The invention allows designing an oligonucleotide with acceptable RNA binding kinetics and/or thermodynamic properties. The RNA binding kinetics and/or thermodynamic properties are at least in part determined by the melting temperature of an oligonucleotide (Tm; calculated with the oligonucleotide properties calculator (www.unc.edu/-cail/biotool/oligo/index.html) for single stranded RNA using the basic Tm and the nearest neighbor model), and/or the free energy of the AON-target exon complex (using RNA structure version 4.5). If a Tm is too high, the oligonucleotide is expected to be less specific. An acceptable Tm and free energy depend on the sequence of the oligonucleotide. Therefore, it is difficult to give preferred ranges for each of these parameters. An acceptable Tm may be ranged between 35 and 70° C. and an acceptable free energy may be ranged between 15 and 45 kcal/mol.

The skilled person may therefore first choose an oligonucleotide as a potential therapeutic compound as binding and/or being complementary to SEQ ID NO: 8, 12, 13, 14, 19, 20, 21, 22, 23, 24, 26, 27, 28, 29, 30, 31, 40, or 41 or a part thereof as defined later herein. The skilled person may check that said oligonucleotide is able to bind to said sequences as earlier defined herein. Optionally in a second step, he may use the invention to further optimize said oligonucleotide by checking for the absence of CpG and/or by optimizing its Tm and/or free energy of the AON-target complex. He may try to design an oligonucleotide wherein few, preferably, no CpG and/or wherein a more acceptable Tm and/or free energy are obtained by choosing a distinct sequence of USH2A (including SEQ ID NO: 8, 12, 13, 14, 19, 20, 21, 22, 23, 24, 26, 27, 28, 29, 30, 31, 40 or 41) to which the oligonucleotide is complementary. Alternatively, if an oligonucleotide complementary to a given stretch within SEQ ID NO: 8, 12, 13, 14, 19, 20, 21, 22, 23, 24, 26, 27, 28, 29, 30, 31, 40 or 41, comprises a CpG, and/or does not have an acceptable Tm and/or free energy, the skilled person may improve any of these parameters by decreasing the length of the oligonucleotide, and/or by choosing a distinct stretch within any of SEQ ID NO: 8, 12, 13, 14, 19, 20, 21, 22, 23, 24, 26, 27, 28, 29, 30, 31, 40 or 41 to which the oligonucleotide is complementary and/or by altering the chemistry of the oligonucleotide.

At any step of the method, an oligonucleotide of the invention is preferably an olignucleotide, which is still able to exhibit an acceptable level of functional activity. A functional activity of said oligonucleotide is preferably to induce the skipping of the aberrant 152 nucleotide USH2A pseudoexon (SEQ ID NO: 5), the aberrant USH2A exon 13 or the aberrant USH2A exon 50 to a certain extent and/or the retention of exon 12, to provide an individual with a functional USH2A protein and/or mRNA and/or at least in part decreasing the production of an aberrant USH2A protein and/or mRNA. In a preferred embodiment, an oligonucleotide is said to induce skipping of the aberrant 152 nucleotide USH2A pseudoexon (SEQ ID NO: 5), when the aberrant 152 nucleotide USH2A pseudoexon (SEQ ID NO: 5) skipping percentage as measured by real-time quantitative RT-PCR analysis is at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100%.

In another preferred embodiment, an oligonucleotide is said to induce skipping of the aberrant USH2A exon 13, when the aberrant USH2A exon 13 skipping percentage as measured by real-time quantitative RT-PCR analysis is at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100%.

In another preferred embodiment, an oligonucleotide is said to induce skipping of the aberrant USH2A exon 50, when the aberrant USH2A exon 50 skipping percentage as measured by real-time quantitative RT-PCR analysis is at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100%.

In an embodiment, an oligonucleotide is said to induce retention of exon 12, when the exon 12 retention percentage as measured by real-time quantitative RT-PCR analysis is at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or 100%.

Preferred assays to determine exon skipping and/or exon retention are described in the examples herein.

Preferably, a nucleic acid molecule according to the invention, preferably an oligonucleotide, which comprises a sequence that is complementary or substantially complementary to a nucleotide sequence as shown in SEQ ID NO: 8, or preferably selected from the group consisting of SEQ ID NO: 12, SEQ ID NO: 13 and SEQ ID NO: 14, or more preferably selected from the group consisting of SEQ ID NO: 19, SEQ ID NO: 20, SEQ ID NO: 21, SEQ ID NO: 22, SEQ ID NO: 23 and SEQ ID NO: 24, or most preferably selected from the group consisting of SEQ ID NO: 26, SEQ ID NO: 27, SEQ ID NO: 28, SEQ ID NO: 29, SEQ ID NO: 30, SEQ ID NO: 31, SEQ ID NO: 40 and SEQ ID NO: 41, or part thereof of USH2A is such that the (substantially) complementary part is at least 50% of the length of the oligonucleotide according to the invention, more preferably at least 60%, even more preferably at least 70%, even more preferably at least 80%, even more preferably at least 90% or even more preferably at least 95%, or even more preferably 98% or even more preferably at least 99%, or even more preferably 100%. Preferably, an oligonucleotide according to the invention comprises or consists of a sequence that is complementary to part of SEQ ID NO: 8, 12, 13, 14, 19, 20, 21, 22, 23, 24, 26, 27, 28, 29, 30, 31, 40 or 41. As an example, an oligonucleotide may comprise a sequence that is complementary to part of SEQ ID NO: 8, 12, 13, 14, 19, 20, 21, 22, 23, 24, 26, 27, 28, 29, 30, 31, 40 or 41 and additional flanking sequences.

In a more preferred embodiment, the length of said complementary part of said oligonucleotide is of at least 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 65, 70, 75, 80, 85, 90, 95, 100, 110, 115, 120, 125, 130, 135, 140, 141, 142 or 143 nucleotides. Additional flanking sequences may be used to modify the binding of a protein to the oligonucleotide, or to modify a thermodynamic property of the oligonucleotide, more preferably to modify target RNA binding affinity.

It is thus not absolutely required that all the bases in the region of complementarity are capable of pairing with bases in the opposing strand. For instance, when designing the oligonucleotide one may want to incorporate for instance a residue that does not base pair with the base on the complementary strand. Mismatches may, to some extent, be allowed, if under the circumstances in the cell, the stretch of nucleotides is sufficiently capable of hybridizing to the complementary part. In this context, "sufficiently" preferably means that using a gel mobility shift assay as described in example 1 of EP1619249, binding of an oligonucleotide is detectable.

Optionally, said oligonucleotide may further be tested by transfection into retina cells of patients. Skipping of a targeted exon or retention of exon 12 may be assessed by RT-PCR (such as e.g. described in EP1619249). The complementary regions are preferably designed such that, when combined, they are specific for the exon in the pre-mRNA. Such specificity may be created with various lengths of complementary regions as this depends on the actual sequences in other (pre-)mRNA molecules in the system. The risk that the oligonucleotide also will be able to hybridize to one or more other pre-mRNA molecules decreases with increasing size of the oligonucleotide. It is clear that oligonucleotides comprising mismatches in the region of complementarity but that retain the capacity to hybridize and/or bind to the targeted region(s) in the pre-mRNA, can be used in the invention. However, preferably at least the complementary parts do not comprise such mismatches as oligonucleotides lacking mismatches in the complementary part typically have a higher efficiency and a higher specificity, than oligonucleotides having such mismatches in one or more complementary regions. It is thought, that higher hybridization strengths, (i.e. increasing number of interactions with the opposing strand) are favorable in increasing the efficiency of the process of interfering with the splicing machinery of the system. Preferably, the complementarity is from 90% to 100%. In general this allows for 1 or 2 mismatch(es) in an oligonucleotide of 20 nucleotides or 1, 2, 3 or 4 mismatches in an oligonucleotide of 40 nucleotides, or 1, 2, 3, 4, 5 or 6 mismatches in an oligonucleotide of 60 nucleotides, etc. An exon skipping molecule of the invention is preferably an isolated molecule. An exon skipping molecule of the invention is preferably a nucleic acid molecule or nucleotide-based molecule, preferably an (antisense) oligonucleotide, which is complementary to a sequence selected from SEQ ID NO: 8, 12, 13, 14, 19, 20, 21, 22, 23, 24, 26, 27, 28, 29, 30, 31, 40 and 41.

A preferred exon skipping molecule or exon 12 retention molecule according to the invention is a nucleic acid molecule comprising an antisense oligonucleotide which antisense oligonucleotide has a length from about 8 to about 143 nucleotides, more preferred from about 8 to 60, more preferred 10 to about 40 nucleotides, more preferred from about 12 to about 30 nucleotides, more preferred from about 14 to about 28 nucleotides, nucleotides, most preferred about 20 nucleotides, such as 15 nucleotides, 16 nucleotides, 17 nucleotides, 18 nucleotides, 19 nucleotides, 20 nucleotides, 21 nucleotides, 22 nucleotides, 23 nucleotides, 24 nucleotides or 25 nucleotides.

A preferred exon skipping molecule or exon 12 retention molecule of the invention is an antisense oligonucleotide comprising or consisting of from 8 to 143 nucleotides, more preferred from 10 to 40 nucleotides, more preferred from 12 to 30 nucleotides, more preferred from 14 to 20 nucleotides, or preferably comprises or consists of 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 65, 70, 75, 80, 85, 90, 95, 100, 110, 115, 120, 125, 130, 135, 140, 141, 142 or 143 nucleotides.

In certain embodiments, the invention provides an exon skipping molecule comprising or preferably consisting of an antisense oligonucleotide selected from the group consisting of SEQ ID NO: 10, SEQ ID NO: 11, SEQ ID NO: 15, SEQ ID NO: 16, SEQ ID NO: 17 and SEQ ID NO: 18. In certain embodiments, the invention provides an exon 12 retention molecule comprising or preferably consisting of antisense oligonucleotide SEQ ID NO: 39.

In a more preferred embodiment, the invention provides an exon skipping molecule comprising or preferably consisting of the antisense oligonucleotide SEQ ID NO: 10. It was found that this molecule is very efficient in modulating splicing of the aberrant 152 nucleotide USH2A pseudoexon. This preferred exon skipping molecule of the invention comprising SEQ ID NO: 10 preferably comprises from 8 to 143 nucleotides, more preferred from 10 to 40 nucleotides, more preferred from 10 to 30 nucleotides, more preferred from 12 to 20 nucleotides, more preferred from 14 to 18 or preferably comprises or consists of 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 65, 70, 75, 80, 85, 90, 95, 100, 110, 115, 120, 125, 130, 135, 140, 141, 142 or 143 nucleotides.

In another more preferred embodiment, the invention provides an exon skipping molecule comprising or preferably consisting of the antisense oligonucleotide SEQ ID NO: 11. It was found that this molecule is very efficient in modulating splicing of the aberrant 152 nucleotide USH2A pseudoexon. This preferred exon skipping molecule of the invention comprising SEQ ID NO: 11 preferably comprises from 8 to 143 nucleotides, more preferred from 10 to 40 nucleotides, more preferred from 10 to 30 nucleotides, more preferred from 12 to 20 nucleotides, more preferably from 14 to 18, or preferably comprises or consists of 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 65, 70, 75, 80, 85, 90, 95, 100, 110, 115, 120, 125, 130, 135, 140, 141, 142 or 143 nucleotides.

In a more preferred embodiment, the invention provides an exon skipping molecule comprising or preferably consisting of the antisense oligonucleotide SEQ ID NO: 15. It was found that this molecule is very efficient in modulating splicing of the aberrant USH2A exon 13. This preferred exon skipping molecule of the invention comprising SEQ ID NO: 15 preferably comprises from 8 to 143 nucleotides, more preferred from 10 to 40 nucleotides, more preferred from 10 to 30 nucleotides, more preferred from 12 to 20 nucleotides, more preferably from 14 to 18 or preferably comprises or consists of 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 65, 70, 75, 80, 85, 90, 95, 100, 110, 115, 120, 125, 130, 135, 140, 141, 142 or 143 nucleotides.

In a more preferred embodiment, the invention provides an exon skipping molecule comprising or preferably consisting of the antisense oligonucleotide SEQ ID NO: 16. It was found that this molecule is very efficient in modulating splicing of the aberrant USH2A exon 13. This preferred exon skipping molecule of the invention comprising SEQ ID NO: 16 preferably comprises from 8 to 143 nucleotides, more preferred from 10 to 40 nucleotides, more preferred from 10 to 30 nucleotides, more preferred from 12 to 20 nucleotides, more preferably from 14 to 18 or preferably comprises or consists of 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 65, 70, 75, 80, 85, 90, 95, 100, 110, 115, 120, 125, 130, 135, 140, 141, 142 or 143 nucleotides.

In a more preferred embodiment, the invention provides an exon skipping molecule comprising or preferably consisting of the antisense oligonucleotide SEQ ID NO: 17. It was found that this molecule is very efficient in modulating splicing of the aberrant USH2A exon 50. This preferred exon skipping molecule of the invention comprising SEQ ID NO: 17 preferably comprises from 8 to 143 nucleotides, more preferred from 10 to 40 nucleotides, more preferred from 10 to 30 nucleotides, more preferred from 12 to 20 nucleotides, more preferably from 14 to 18 or preferably comprises or consists of 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 65, 70, 75, 80, 85, 90, 95, 100, 110, 115, 120, 125, 130, 135, 140, 141, 142 or 143 nucleotides.

In a more preferred embodiment, the invention provides an exon skipping molecule comprising or preferably consisting of the antisense oligonucleotide SEQ ID NO: 18. It was found that this molecule is very efficient in modulating splicing of the aberrant USH2A exon 50. This preferred exon skipping molecule of the invention comprising SEQ ID NO: 18 preferably comprises from 8 to 143 nucleotides, more preferred from 10 to 40 nucleotides, more preferred from 10 to 30 nucleotides, more preferred from 12 to 20 nucleotides, more preferably from 14 to 18 or preferably comprises or consists of 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 65, 70, 75, 80, 85, 90, 95, 100, 110, 115, 120, 125, 130, 135, 140, 141, 142 or 143 nucleotides.

An exon skipping molecule or an exon 12 retention molecule according to the invention may contain one of more RNA residues, or one or more DNA residues, and/or one or more nucleotide analogues or equivalents, as will be further detailed herein below.

It is preferred that an exon skipping molecule or exon 12 retention molecule of the invention comprises one or more residues that are modified to increase nuclease resistance, and/or to increase the affinity of the antisense oligonucleotide for the target sequence. Therefore, in a preferred embodiment, the antisense nucleotide sequence comprises at least one nucleotide analogue or equivalent, wherein a nucleotide analogue or equivalent is defined as a residue having a modified base, and/or a modified backbone, and/or a non-natural internucleoside linkage, or a combination of these modifications.

In a preferred embodiment, the nucleotide analogue or equivalent comprises a modified backbone. Examples of such backbones are provided by morpholino backbones, carbamate backbones, siloxane backbones, sulfide, sulfoxide and sulfone backbones, formacetyl and thioformacetyl backbones, methyleneformacetyl backbones, riboacetyl backbones, alkene containing backbones, sulfamate, sulfonate and sulfonamide backbones, methyleneimino and methylenehydrazino backbones, and amide backbones. Phosphorodiamidate morpholino oligomers are modified backbone oligonucleotides that have previously been investigated as antisense agents.

Morpholino oligonucleotides have an uncharged backbone in which the deoxyribose sugar of DNA is replaced by a six membered ring and the phosphodiester linkage is replaced by a phosphorodiamidate linkage. Morpholino oligonucleotides are resistant to enzymatic degradation and appear to function as antisense agents by arresting translation or interfering with pre-mRNA splicing rather than by activating RNase H. Morpholino oligonucleotides have been successfully delivered to tissue culture cells by methods that physically disrupt the cell membrane, and one study comparing several of these methods found that scrape loading was the most efficient method of delivery; however, because the morpholino backbone is uncharged, cationic lipids are not effective mediators of morpholino oligonucleotide uptake in cells. A recent report demonstrated triplex formation by a morpholino oligonucleotide and, because of the non-ionic backbone, these studies showed that the morpholino oligonucleotide was capable of triplex formation in the absence of magnesium.

It is further preferred that the linkage between the residues in a backbone do not include a phosphorus atom, such as a linkage that is formed by short chain alkyl or cycloalkyl internucleoside linkages, mixed heteroatom and alkyl or cycloalkyl internucleoside linkages, or one or more short chain heteroatomic or heterocyclic internucleoside linkages.

A preferred nucleotide analogue or equivalent comprises a Peptide Nucleic Acid (PNA), having a modified polyamide backbone (Nielsen, et al. (1991) Science 254, 1497-1500). PNA-based molecules are true mimics of DNA molecules in terms of base-pair recognition. The backbone of the PNA is composed of N-(2-aminoethyl)-glycine units linked by peptide bonds, wherein the nucleobases are linked to the backbone by methylene carbonyl bonds. An alternative backbone comprises a one-carbon extended pyrrolidine PNA monomer (Govindaraju and Kumar (2005) Chem. Commun, 495-497). Since the backbone of a PNA molecule contains no charged phosphate groups, PNA-RNA hybrids are usually more stable than RNA-RNA or RNA-DNA hybrids, respectively (Egholm et al (1993) Nature 365, 566-568). A further preferred backbone comprises a morpholino nucleotide analog or equivalent, in which the ribose or deoxyribose sugar is replaced by a 6-membered morpholino ring. A most preferred nucleotide analog or equivalent comprises a phosphorodiamidate morpholino oligomer (PMO), in which the ribose or deoxyribose sugar is replaced by a 6-membered morpholino ring, and the anionic phosphodiester linkage between adjacent morpholino rings is replaced by a non-ionic phosphorodiamidate linkage.

In yet a further embodiment, a nucleotide analogue or equivalent of the invention comprises a substitution of one of the non-bridging oxygens in the phosphodiester linkage. This modification slightly destabilizes base-pairing but adds significant resistance to nuclease degradation. A preferred nucleotide analogue or equivalent comprises phosphorothioate, chiral phosphorothioate, phosphorodithioate, phosphotriester, aminoalkylphosphotriester, H-phosphonate, methyl and other alkyl phosphonate including 3'-alkylene phosphonate, 5'-alkylene phosphonate and chiral phosphonate, phosphinate, phosphoramidate including 3'-amino phosphoramidate and aminoalkylphosphoramidate, thionophosphoramidate, thionoalkylphosphonate, thionoalkylphosphotriester, selenophosphate or boranophosphate.

A further preferred nucleotide analogue or equivalent of the invention comprises one or more sugar moieties that are mono- or disubstituted at the 2', 3' and/or 5' position such as a —OH; —F; substituted or unsubstituted, linear or branched lower (C1-C10) alkyl, alkenyl, alkynyl, alkaryl, allyl, or aralkyl, that may be interrupted by one or more heteroatoms; O-, S-, or N-alkyl; O-, S-, or N-alkenyl; O-, S- or N-alkynyl; O-, S-, or N-allyl; O-alkyl-O-alkyl, -methoxy, -aminopropoxy; methoxyethoxy; dimethylaminooxyethoxy; and -dimethylaminoethoxyethoxy. The sugar moiety can be a pyranose or derivative thereof, or a deoxypyranose or derivative thereof, preferably ribose or derivative thereof, or deoxyribose or derivative of. A preferred derivatized sugar moiety comprises a Locked Nucleic Acid (LNA), in which the 2'-carbon atom is linked to the 3' or 4' carbon atom of the sugar ring thereby forming a bicyclic sugar moiety. A preferred LNA comprises 2'-O, 4'-C-ethylene-bridged nucleic acid (Morita et al. 2001. Nucleic Acid Res Supplement No. 1: 241-242). These substitutions render the nucleotide analogue or equivalent RNase H and nuclease resistant and increase the affinity for the target RNA.

In another embodiment, a nucleotide analogue or equivalent of the invention comprises one or more base modifications or substitutions. Modified bases comprise synthetic and natural bases such as inosine, xanthine, hypoxanthine and other -aza, deaza, -hydroxy, -halo, -thio, thiol, -alkyl, -alkenyl, -alkynyl, thioalkyl derivatives of pyrimidine and purine bases that are or will be known in the art.

It is understood by a skilled person that it is not necessary for all positions in an antisense oligonucleotide to be modified uniformly. In addition, more than one of the aforementioned analogues or equivalents may be incorporated in a single antisense oligonucleotide or even at a single position within an antisense oligonucleotide. In certain embodiments, an antisense oligonucleotide of the invention has at least two different types of analogues or equivalents.

A preferred exon skipping molecule according to the invention comprises a 2'-O alkyl phosphorothioate antisense oligonucleotide, such as 2'-O-methyl modified ribose (RNA), 2'-O-ethyl modified ribose, 2'-O-propyl modified ribose, and/or substituted derivatives of these modifications such as halogenated derivatives. An effective antisense oligonucleotide according to the invention comprises a 2'-O-methyl ribosewith a phosphorothioate backbone.

It will also be understood by a skilled person that different antisense oligonucleotides can be combined for efficiently skipping of the aberrant 152 nucleotide pseudoexon of USH2A, the aberrant USH2A exon 13 or the aberrant USH2A exon 50. In a preferred embodiment, a combination of at least two antisense oligonucleotides are used in a method of the invention, such as two different antisense oligonucleotides, three different antisense oligonucleotides, four different antisense oligonucleotides, or five different antisense oligonucleotides. A preferred set of exon skipping molecules comprises an antisense oligonucleotide according to the invention, which comprises a sequence that is complementary or substantially complementary to a nucleotide sequence as shown in SEQ ID NO: 19 and an antisense oligonucleotide according to the invention, which comprises a sequence that is complementary or substantially complementary to a nucleotide sequence as shown in SEQ ID NO: 20. A further preferred set of exon skipping molecules comprises an antisense oligonucleotide according to the invention, which comprises a sequence that is complementary or substantially complementary to a nucleotide sequence as shown in SEQ ID NO: 21 and an antisense oligonucleotide according to the invention, which comprises a sequence that is complementary or substantially complementary to a nucleotide sequence as shown in SEQ ID NO: 22. A further preferred set of exon skipping molecules comprises an antisense oligonucleotide according to the invention, which comprises a sequence that is complementary or substantially complementary to a nucleotide sequence as shown in SEQ ID NO: 23 and an antisense oligonucleotide according to the invention, which comprises a sequence that is complementary or substantially complementary to a nucleotide sequence as shown in SEQ ID NO: 24. A more preferred set of exon skipping molecules comprises an antisense oligonucleotide according to the invention, which comprises a sequence that is complementary or substantially complementary to a nucleotide sequence as shown in SEQ ID NO: 26 and an antisense oligonucleotide according to the invention, which comprises a sequence that is complementary or substantially complementary to a nucleotide sequence as shown in SEQ ID NO: 27. A further more preferred set of exon skipping molecules comprises an antisense oligonucleotide according to the invention, which comprises a sequence that is complementary or substantially complementary to a nucleotide sequence as shown in SEQ ID NO: 28 and an antisense oligonucleotide according to the invention, which comprises a sequence that is complementary or substantially complementary to a nucleotide sequence as shown in SEQ ID NO: 29. A further more preferred set of exon skipping molecules comprises an antisense oligonucleotide according to the invention, which comprises a sequence that is complementary or substantially complementary to a nucleotide sequence as shown in SEQ ID NO: 30 and an antisense oligonucleotide according to the invention, which comprises a sequence that is complementary or substantially complementary to a nucleotide sequence as shown in SEQ ID NO: 31. An even more preferred set of exon skipping molecules comprises an exon skipping molecule according to the invention comprising or preferably consisting of the antisense oligonucleotide SEQ ID NO: 10 and an exon skipping molecule according to the invention comprising or preferably consisting of the antisense oligonucleotide SEQ ID NO: 11. A further even more preferred set of exon skipping molecules comprises an exon skipping molecule according to the invention comprising or preferably consisting of the antisense oligonucleotide SEQ ID NO: 15 and an exon skipping molecule according to the invention comprising or preferably consisting of the antisense oligonucleotide SEQ ID NO: 16. A further even more preferred set of exon skipping molecules comprises an exon skipping molecule according to the invention comprising or preferably consisting of the antisense oligonucleotide SEQ ID NO: 17 and an exon skipping molecule according to the invention comprising or preferably consisting of the antisense oligonucleotide SEQ ID NO: 18.

Skipping of exon 13 may lead to the inadvertent skipping of exon 12 as well. Accordingly, there is provided a retention molecule for exon 12. A preferred exon 12 retention molecule according to the invention is a nucleic acid molecule, preferably an oligonucleotide which is complementary or substantially complementary to a nucleotide sequence as shown in SEQ ID NO: 40, more preferably to a nucleotide sequence as shown in SEQ ID NO: 41. A more preferred exon 12 retention molecule according to the invention is an oligonucleotide comprising or preferably consisting of the antisense oligonucleotide SEQ ID NO: 39.

In an embodiment, the invention provides an exon 12 retention molecule comprising or preferably consisting of the antisense oligonucleotide SEQ ID NO: 39. It was found that this molecule is very efficient in retention of exon 12. This preferred exon 12 retention molecule according to the invention comprising SEQ ID NO: 39 preferably comprises from 8 to 143 nucleotides, more preferred from 10 to 40 nucleotides, more preferred from 10 to 30 nucleotides, more preferred from 12 to 20 nucleotides, more preferably from 14 to 18 or preferably comprises or consists of 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 65, 70, 75, 80, 85, 90, 95, 100, 110, 115, 120, 125, 130, 135, 140, 141, 142 or 143 nucleotides. Said exon 12 retention molecule according to the invention is preferably combined with an exon skipping molecule according to the invention for skipping of exon 13. A preferred combination of an exon 12 retention molecule according to the invention and an exon 13 skipping molecule according to the invention comprises an antisense oligonucleotide according to the invention, which comprises a sequence that is complementary or substantially complementary to a nucleotide sequence as shown in SEQ ID NO: 40 and an antisense oligonucleotide according to the invention which comprises a sequence that is complementary or substantially complementary to a nucleotide sequence as shown in SEQ ID NO: 21. A further preferred combination of an exon 12 retention molecule according to the invention and an exon 13 skipping molecule according to the invention comprises an antisense oligonucleotide according to the invention which comprises a sequence that is complementary or substantially complementary to a nucleotide sequence as shown in SEQ ID NO: 40 and an antisense oligonucleotide according to the invention which comprises a sequence that is complementary or substantially complementary to a nucleotide sequence as shown in SEQ ID NO: 22. A more preferred combination of an exon 12 retention molecule according to the invention and an exon 13 skipping molecule according to the invention comprises an antisense oligonucleotide according to the invention which comprises a sequence that is complementary or substantially complementary to a nucleotide sequence as shown in SEQ ID NO: 40, an antisense oligonucleotide according to the invention which comprises a sequence that is complementary or substantially complementary to a nucleotide sequence as shown in SEQ ID NO: 21 and an antisense oligonucleotide according to the invention which comprises a sequence that is complementary or substantially complementary to a nucleotide sequence as shown in SEQ ID NO: 22. A further more preferred combination of an exon 12 retention molecule according to the invention and an exon 13 skipping molecule according to the invention comprises an antisense oligonucleotide according to the invention, which comprises a sequence that is complementary or substantially complementary to a nucleotide sequence as shown in SEQ ID NO: 41 and an antisense oligonucleotide according to the invention which comprises a sequence that is complementary or substantially complementary to a nucleotide sequence as shown in SEQ ID NO: 28. A further more preferred combination of an exon 12 retention molecule according to the invention and an exon 13 skipping molecule according to the invention comprises an antisense oligonucleotide according to the invention, which comprises a sequence that is complementary or substantially complementary to a nucleotide sequence as shown in SEQ ID NO: 41 and an antisense oligonucleotide according to the invention which comprises a sequence that is complementary or substantially complementary to a nucleotide sequence as shown in SEQ ID NO: 29. A even more preferred combination of an exon 12 retention molecule according to the invention and an exon 13 skipping molecule according to the invention comprises an antisense oligonucleotide according to the invention, which comprises a sequence that is complementary or substantially complementary to a nucleotide sequence as shown in SEQ ID NO: 41, an antisense oligonucleotide according to the invention which comprises a sequence that is complementary or substantially complementary to a nucleotide sequence as shown in SEQ ID NO: 28 and an antisense oligonucleotide according to the invention which comprises a sequence that is complementary or substantially complementary to a nucleotide sequence as shown in SEQ ID NO: 29.

An even more preferred combination of an exon 12 retention molecule according to the invention and an exon 13 skipping molecule according to the invention comprises an oligonucleotide comprising or preferably consisting of the antisense oligonucleotide SEQ ID NO: 39 and an exon skipping molecule according to the invention comprising or preferably consisting of the antisense oligonucleotide SEQ ID NO: 15. A further even more preferred combination of an exon 12 retention molecule according to the invention and an exon 13 skipping molecule according to the invention comprises an oligonucleotide comprising or preferably consisting of the antisense oligonucleotide SEQ ID NO: 39 and an exon skipping molecule according to the invention comprising or preferably consisting of the antisense oligonucleotide SEQ ID NO: 16. A further even more preferred combination of an exon 12 retention molecule according to the invention and an exon 13 skipping molecule according to the invention comprises an oligonucleotide comprising or preferably consisting of the antisense oligonucleotide SEQ ID NO: 39, an exon skipping molecule according to the invention comprising or preferably consisting of the antisense oligonucleotide SEQ ID NO: 15 and an exon skipping molecule according to the invention comprising or preferably consisting of the antisense oligonucleotide SEQ ID NO: 16. In all embodiments of the invention relating to skipping of exon 13 it is to be understood that skipping of exon 13 can be combined with the retention of exon 12 with an exon 12 retention molecule provided herein.

An antisense oligonucleotide can be linked to a moiety that enhances uptake of the antisense oligonucleotide in cells, preferably retina cells. Examples of such moieties are cholesterols, carbohydrates, vitamins, biotin, lipids, phospholipids, cell-penetrating peptides including but not limited to antennapedia, TAT, transportan and positively charged amino acids such as oligoarginine, poly-arginine, oligolysine or polylysine, antigen-binding domains such as provided by an antibody, a Fab fragment of an antibody, or a single chain antigen binding domain such as a cameloid single domain antigen-binding domain.

An exon skipping molecule or exon 12 retention molecule according to the invention may be indirectly administrated using suitable means known in the art. When the exon skipping molecule or exon 12 retention molecule is an oligonucleotide, it may for example be provided to an individual or a cell, tissue or organ of said individual in the form of an expression vector wherein the expression vector encodes a transcript comprising said oligonucleotide. The expression vector is preferably introduced into a cell, tissue, organ or individual via a gene delivery vehicle. In a preferred embodiment, there is provided a viral-based expression vector comprising an expression cassette or a transcription cassette that drives expression or transcription of an exon skipping molecule or exon 12 retention molecule as identified herein. Accordingly, the invention provides a viral vector expressing an exon skipping molecule or exon 12 retention molecule according to the invention when placed under conditions conducive to expression of the exon skipping molecule. A cell can be provided with an exon skipping molecule capable of interfering with essential sequences that result in highly efficient skipping of the aberrant 152 nucleotide USH2A pseudoexon, the aberrant USH2A exon 13 or the aberrant USH2A exon 50 by plasmid-derived antisense oligonucleotide expression or viral expression provided by adenovirus- or adeno-associated virus-based vectors. Likewise exon 12 retention can be mediated by plasmid-derived antisense oligonucleotide expression or viral expression provided by adenovirus- or adeno-associated virus-based vectors. Expression may be driven by a polymerase II-promoter (Pol II) such as a U7 promoter or a polymerase III (Pol III) promoter, such as a U6 RNA promoter. A preferred delivery vehicle is a viral vector such as an adenoassociated virus vector (AAV), or a retroviral vector such as a lentivirus vector and the like. Also, plasmids, artificial chromosomes, plasmids usable for targeted homologous recombination and integration in the human genome of cells may be suitably applied for delivery of an oligonucleotide as defined herein. Preferred for the current invention are those vectors wherein transcription is driven from PolIII promoters, and/or wherein transcripts are in the form fusions with U1 or U7 transcripts, which yield good results for delivering small transcripts. It is within the skill of the artisan to design suitable transcripts. Preferred are PolIII driven transcripts, preferably, in the form of a fusion transcript with an U1 or U7 transcript. Such fusions may be generated as described (Gorman L et al, 1998 or Suter D et al, 1999).

The exon skipping molecule or exon 12 retention molecule according to the invention, preferably an antisense oligonucleotide, may be delivered as such. However, the exon skipping molecule or exon 12 retention molecule may also be encoded by the viral vector. Typically, this is in the form of an RNA transcript that comprises the sequence of an oligonucleotide according to the invention in a part of the transcript.

One preferred antisense oligonucleotide expression system is an adenovirus associated virus (AAV)-based vector. Single chain and double chain AAV-based vectors have been developed that can be used for prolonged expression of small antisense nucleotide sequences for highly efficient skipping of the aberrant 152 nucleotide USH2A pseudoexon, the aberrant USH2A exon 13 or the aberrant USH2A exon 50 or for effective retention of exon 12.

A preferred AAV-based vector for instance comprises an expression cassette that is driven by a polymerase III-promoter (Pol III) or a polymerase II-promoter (Pol II). A preferred RNA promoter is, for example, a Pol III U6 RNA promoter, or a Pol II U7 RNA promoter.

The invention therefore also provides a viral-based vector, comprising a Pol II or a Pol III promoter driven expression cassette for expression of an antisense oligonucleotide of the invention for inducing skipping of aberrant 152 nucleotide USH2A pseudoexon, the aberrant USH2A exon 13 or the aberrant USH2A exon 50 or for retention of exon 12.

An AAV vector according to the invention is a recombinant AAV vector and refers to an AAV vector comprising part of an AAV genome comprising an encoded exon skipping molecule or exon 12 retention molecule according to the invention encapsidated in a protein shell of capsid protein derived from an AAV serotype as depicted elsewhere herein. Part of an AAV genome may contain the inverted terminal repeats (ITR) derived from an adeno-associated virus serotype, such as AAV1, AAV2, AAV3, AAV4, AAV5, AAV8, AAV9 and others. Protein shell comprised of capsid protein may be derived from an AAV serotype such as AAV1, 2, 3, 4, 5, 8, 9 and others. A protein shell may also be named a capsid protein shell. AAV vector may have one or preferably all wild type AAV genes deleted, but may still comprise functional ITR nucleic acid sequences. Functional ITR sequences are necessary for the replication, rescue and packaging of AAV virions. The ITR sequences may be wild type sequences or may have at least 80%, 85%, 90%, 95, or 100% sequence identity with wild type sequences or may be altered by for example in insertion, mutation, deletion or substitution of nucleotides, as long as they remain functional. In this context, functionality refers to the ability to direct packaging of the genome into the capsid shell and then allow for expression in the host cell to be infected or target cell. In the context of the invention a capsid protein shell may be of a different serotype than the AAV vector genome ITR. An AAV vector according to present the invention may thus be composed of a capsid protein shell, i.e. the icosahedral capsid, which comprises capsid proteins (VP1, VP2, and/or VP3) of one AAV serotype, e.g. AAV serotype 2, whereas the ITRs sequences contained in that AAV5 vector may be any of the AAV serotypes described above, including an AAV2 vector. An "AAV2 vector" thus comprises a capsid protein shell of AAV serotype 2, while e.g. an "AAV5 vector" comprises a capsid protein shell of AAV serotype 5, whereby either may encapsidate any AAV vector genome ITR according to the invention.

Preferably, a recombinant AAV vector according to the invention comprises a capsid protein shell of AAV serotype 2, 5, 8 or AAV serotype 9 wherein the AAV genome or ITRs present in said AAV vector are derived from AAV serotype 2, 5, 8 or AAV serotype 9; such AAV vector is referred to as an AAV2/2, AAV 2/5, AAV2/8, AAV2/9, AAV5/2, AAV5/5, AAV5/8, AAV 5/9, AAV8/2, AAV 8/5, AAV8/8, AAV8/9, AAV9/2, AAV9/5, AAV9/8, or an AAV9/9 vector.

More preferably, a recombinant AAV vector according to the invention comprises a capsid protein shell of AAV serotype 2 and the AAV genome or ITRs present in said vector are derived from AAV serotype 5; such vector is referred to as an AAV 2/5 vector.

More preferably, a recombinant AAV vector according to the invention comprises a capsid protein shell of AAV serotype 2 and the AAV genome or ITRs present in said vector are derived from AAV serotype 8; such vector is referred to as an AAV 2/8 vector.

More preferably, a recombinant AAV vector according to the invention comprises a capsid protein shell of AAV serotype 2 and the AAV genome or ITRs present in said vector are derived from AAV serotype 9; such vector is referred to as an AAV 2/9 vector.

More preferably, a recombinant AAV vector according to the invention comprises a capsid protein shell of AAV serotype 2 and the AAV genome or ITRs present in said vector are derived from AAV serotype 2; such vector is referred to as an AAV 2/2 vector.

A nucleic acid molecule encoding an exon skipping molecule or exon 12 retention molecule according to the invention represented by a nucleic acid sequence of choice is preferably inserted between the AAV genome or ITR sequences as identified above, for example an expression construct comprising an expression regulatory element operably linked to a coding sequence and a 3' termination sequence.

"AAV helper functions" generally refers to the corresponding AAV functions required for AAV replication and packaging supplied to the AAV vector in trans. AAV helper functions complement the AAV functions which are missing in the AAV vector, but they lack AAV ITRs (which are provided by the AAV vector genome). AAV helper functions include the two major ORFs of AAV, namely the rep coding region and the cap coding region or functional substantially identical sequences thereof. Rep and Cap regions are well known in the art, see e.g. Chiorini et al. (1999, J. of Virology, Vol 73(2): 1309-1319) or U.S. Pat. No. 5,139,941, incorporated herein by reference. The AAV helper functions can be supplied on a AAV helper construct, which may be a plasmid. Introduction of the helper construct into the host cell can occur e.g. by transformation, transfection, or transduction prior to or concurrently with the introduction of the AAV genome present in the AAV vector as identified herein. The AAV helper constructs of the invention may thus be chosen such that they produce the desired combination of serotypes for the AAV vector's capsid protein shell on the one hand and for the AAV genome present in said AAV vector replication and packaging on the other hand. "AAV helper virus" provides additional functions required for AAV replication and packaging. Suitable AAV helper viruses include adenoviruses, herpes simplex viruses (such as HSV types 1 and 2) and vaccinia viruses. The additional functions provided by the helper virus can also be introduced into the host cell via vectors, as described in U.S. Pat. No. 6,531,456 incorporated herein by reference.

Preferably, an AAV genome as present in a recombinant AAV vector according to the invention does not comprise any nucleotide sequences encoding viral proteins, such as the rep (replication) or cap (capsid) genes of AAV. An AAV genome may further comprise a marker or reporter gene, such as a gene for example encoding an antibiotic resistance gene, a fluorescent protein (e.g. gfp) or a gene encoding a chemically, enzymatically or otherwise detectable and/or selectable product (e.g. lacZ, aph, etc.) known in the art.

Preferably, an AAV vector according to the invention is constructed and produced according to the methods in the Examples herein.

A preferred AAV vector according to the invention is an AAV vector, preferably an AAV2/5, AAV2/8, AAV2/9 or AAV2/2 vector, expressing an exon skipping molecule or an exon 12 retention molecule according to the invention that is an antisense oligonucleotide that comprises, or preferably consists of, a sequence that is complementary or substantially complementary to a nucleotide sequence as shown in SEQ ID NO: 8, or preferably selected from the group consisting of SEQ ID NO: 12, SEQ ID NO: 13 and SEQ ID NO: 14, or more preferably selected from the group consisting of SEQ ID NO: 19, SEQ ID NO: 20, SEQ ID NO: 21, SEQ ID NO: 22, SEQ ID NO: 23 and SEQ ID NO: 24, or most preferably selected from the group consisting of SEQ ID NO: 26, SEQ ID NO: 27, SEQ ID NO: 28, SEQ ID NO: 29, SEQ ID NO: 30, SEQ ID NO: 31, SEQ ID NO: 40 and SEQ ID NO: 41.

A further preferred AAV vector according to the invention is an AAV vector, preferably an AAV2/5, AAV2/8, AAV2/9 or AAV2/2 vector, expressing an exon skipping molecule or an exon 12 retention molecule according to the invention that is an antisense oligonucleotide that comprises, or preferably consists of, SEQ ID NO: 10, 11, 15, 16, 17, 18 or 39.

Figure 7:
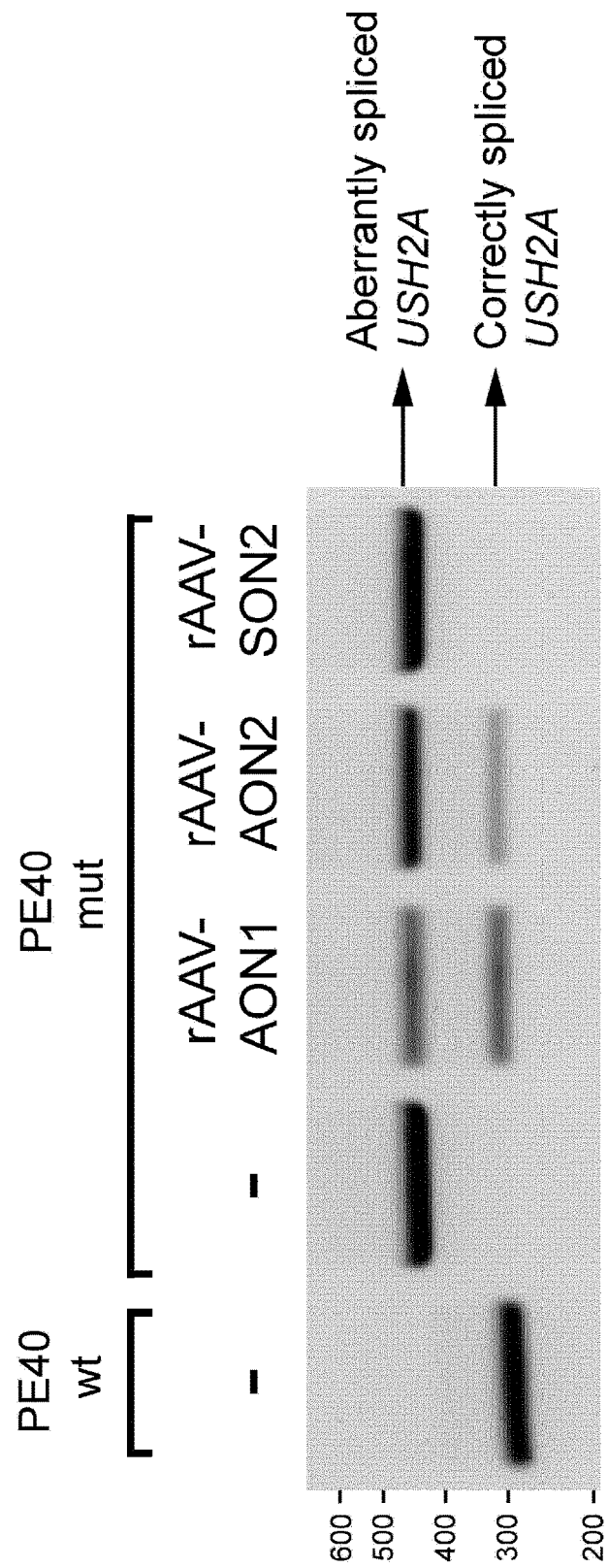

A further preferred AAV vector according to the invention, preferably an AAV2/5, AAV2/8, AAV2/9 or AAV2/2 vector, is a virion corresponding to one of rAAV-AON1 and rAAV-AON2, as depicted in FIG. 7 as constructed and produced in the examples.

Improvements in means for providing an individual or a cell, tissue, organ of said individual with an exon skipping molecule according to the invention, are anticipated considering the progress that has already thus far been achieved. Such future improvements may of course be incorporated to achieve the mentioned effect on restructuring of mRNA using a method of the invention. An exon skipping molecule according to the invention can be delivered as is to an individual, a cell, tissue or organ of said individual. When administering an exon skipping molecule according to the invention, it is preferred that the molecule is dissolved in a solution that is compatible with the delivery method. Retina or inner ear cells can be provided with a plasmid for antisense oligonucleotide expression by providing the plasmid in an aqueous solution. Alternatively, a preferred delivery method for an antisense oligonucleotide or a plasmid for antisense oligonucleotide expression is a viral vector or nanoparticles. Preferably viral vectors or nanoparticles are delivered to retina or inner ear cells. Such delivery to retina or inner ear cells or other relevant cells may be in vivo, in vitro or ex vivo. Alternatively, a plasmid can be provided by transfection using known transfection agentia. For intravenous, subcutaneous, intramuscular, intrathecal and/or intraventricular administration it is preferred that the solution is a physiological salt solution. Particularly preferred in the invention is the use of an excipient or transfection agentia that will aid in delivery of each of the constituents as defined herein to a cell and/or into a cell, preferably a retina cell. Preferred are excipients or transfection agentia capable of forming complexes, nanoparticles, micelles, vesicles and/or liposomes that deliver each constituent as defined herein, complexed or trapped in a vesicle or liposome through a cell membrane. Many of these excipients are known in the art. Suitable excipients or transfection agentia comprise polyethylenimine (PEI; ExGen500 (MBI Fermentas)), LipofectAMINE™ 2000 (Invitrogen) or derivatives thereof, or similar cationic polymers, including polypropyleneimine or polyethylenimine copolymers (PECs) and derivatives, synthetic amphiphils (SAINT-18), Lipofectin™, DOTAP and/or viral capsid proteins that are capable of self assembly into particles that can deliver each constitutent as defined herein to a cell, preferably a retina cell. Such excipients have been shown to efficiently deliver an oligonucleotide such as antisense nucleic acids to a wide variety of cultured cells, including retina cells. Their high transfection potential is combined with an excepted low to moderate toxicity in terms of overall cell survival. The ease of structural modification can be used to allow further modifications and the analysis of their further (in vivo) nucleic acid transfer characteristics and toxicity.

Lipofectin represents an example of a liposomal transfection agent. It consists of two lipid components, a cationic lipid N-[1-(2,3 dioleoyloxy)propyl]-N, N, N-trimethylammonium chloride (DOTMA) (cp. DOTAP which is the methylsulfate salt) and a neutral lipid dioleoylphosphatidylethanolamine (DOPE). The neutral component mediates the intracellular release. Another group of delivery systems are polymeric nanoparticles.

Polycations such as diethylaminoethylamino ethyl (DEAE)-dextran, which are well known as DNA transfection reagent can be combined with butylcyanoacrylate (PBCA) and hexylcyanoacrylate (PHCA) to formulate cationic nanoparticles that can deliver each constituent as defined herein, preferably an oligonucleotide, across cell membranes into cells.

In addition to these common nanoparticle materials, the cationic peptide protamine offers an alternative approach to formulate an oligonucleotide with colloids. This colloidal nanoparticle system can form so called proticles, which can be prepared by a simple self-assembly process to package and mediate intracellular release of an oligonucleotide. The skilled person may select and adapt any of the above or other commercially available alternative excipients and delivery systems to package and deliver an exon skipping molecule for use in the current invention to deliver it for the prevention, treatment or delay of a USH2A related disease or condition. "Prevention, treatment or delay of a USH2A related disease or condition" is herein preferably defined as preventing, halting, ceasing the progression of, or reversing partial or complete visual impairment or blindness, as well as preventing, halting, ceasing the progression of or reversing partial or complete auditory impairment or deafness that is caused by a genetic defect in the USH2A gene.

In addition, an exon skipping molecule or exon 12 retention molecule according to the invention could be covalently or non-covalently linked to a targeting ligand specifically designed to facilitate the uptake into the cell, cytoplasm and/or its nucleus. Such ligand could comprise (i) a compound (including but not limited to peptide(-like) structures) recognising cell, tissue or organ specific elements facilitating cellular uptake and/or (ii) a chemical compound able to facilitate the uptake in to cells and/or the intracellular release of an oligonucleotide from vesicles, e.g. endosomes or lysosomes.

Therefore, in a preferred embodiment, an exon skipping molecule or exon 12 retention molecule according to the invention is formulated in a composition or a medicament or a composition, which is provided with at least an excipient and/or a targeting ligand for delivery and/or a delivery device thereof to a cell and/or enhancing its intracellular delivery.

It is to be understood that if a composition comprises an additional constituent such as an adjunct compound as later defined herein, each constituent of the composition may not be formulated in one single combination or composition or preparation. Depending on their identity, the skilled person will know which type of formulation is the most appropriate for each constituent as defined herein. In a preferred embodiment, the invention provides a composition or a preparation which is in the form of a kit of parts comprising an exon skipping molecule according to the invention and a further adjunct compound as later defined herein.

If required, an exon skipping molecule or exon 12 retention molecule according to the invention or a vector, preferably a viral vector, expressing an exon skipping molecule or exon 12 retention molecule according to the invention can be incorporated into a pharmaceutically active mixture by adding a pharmaceutically acceptable carrier. Accordingly, the invention also provides a composition, preferably a pharmaceutical composition, comprising an exon skipping molecule or exon 12 retention molecule according to the invention, or a viral vector according to the invention and a pharmaceutically acceptable excipient. Such composition may comprise a single exon skipping molecule, exon 12 retention molecule or viral vector according to the invention, but may also comprise multiple, distinct exon skipping molecules, exon 12 retention molecules or viral vectors according to the invention. Such a pharmaceutical composition may comprise any pharmaceutically acceptable excipient, including a carrier, filler, preservative, adjuvant, solubilizer and/or diluent. Such pharmaceutically acceptable carrier, filler, preservative, adjuvant, solubilizer and/or diluent may for instance be found in Remington, 2000. Each feature of said composition has earlier been defined herein.

A preferred route of administration is through intra-vitreal injection of an aqueous solution or specially adapted formulation for intraocular administration. EP 2 425 814 discloses an oil in water emulsion especially adapted for intraocular (intravitreal) administration of peptide or nucleic acid drugs. This emulsion is less dense than the vitreous fluid, so that the emulsion floats on top of the vitreous, avoiding that the injected drug impairs vision.

If multiple distinct exon skipping molecules according to the invention are used, optionally combined with an exon 12 retention molecule according to the invention, concentration or dose defined herein may refer to the total concentration or dose of all oligonucleotides used or the concentration or dose of each exon skipping molecule used or added. Therefore in one embodiment, there is provided a composition wherein each or the total amount of exon skipping molecules and or exon 12 skipping molecules according to the invention used is dosed in an amount ranged from 0.01 and 20 mg/kg, preferably from 0.05 and 20 mg/kg. A suitable intravitreal dose would be between 0.05 mg and 5 mg, preferably between 0.1 and 1mg per eye, such as about per eye: 0.1, 0.2, 0.3, 0.4, 0.5, 0.6, 0.7, 0.8, 0.9 or 1.0 mg.

A preferred exon skipping molecule and/or exon retention molecule according to the invention, is for the treatment of a USH2A related disease or condition of an individual. In all embodiments of the invention, the term "treatment" is understood to include the prevention and/or delay of the USH2A related disease or condition. An individual, which may be treated using an exon skipping molecule and/or exon 12 retention molecule according to the invention may already have been diagnosed as having a USH2A related disease or condition.

Alternatively, an individual which may be treated using an exon skipping molecule and/or exon 12 retention molecule according to the invention may not have yet been diagnosed as having a USH2A related disease or condition but may be an individual having an increased risk of developing a USH2A related disease or condition in the future given his or her genetic background. A preferred individual is a human being. In a preferred embodiment the USH2A related disease or condition is Usher Syndrome type 2.

Accordingly, the invention further provides an exon skipping molecule and/or an exon 12 retention molecule according to the invention, or a viral vector according to the invention, or a composition according to the invention for use as a medicament, for treating a USH2A related disease or condition requiring modulating splicing of USH2A and for use as a medicament for the prevention, treatment or delay of a USH2A related disease or condition. A preferred USH2A related disease or condition is Usher Syndrome type 2. Each feature of said use has earlier been defined herein.

The invention further provides the use of an exon skipping molecule and/or exon 12 retention molecule according to the invention, or of a viral vector according to the invention, or a composition according to the invention for the treatment of a USH2A related disease or condition requiring modulating splicing of USH2A. In a preferred embodiment the USH2A related disease or condition is Usher Syndrome type 2.

The invention further provides the use of an exon skipping molecule and/or exon 12 retention molecule according to the invention, or of a viral vector according to the invention, or a composition according to the invention for the preparation of a medicament, for the preparation of a medicament for treating a USH2A related disease or condition requiring modulating splicing of USH2A and for the preparation of a medicament for the prevention, treatment or delay of a USH2A related disease or condition. A preferred USH2A related disease or condition is Usher Syndrome type 2. Therefore in a further aspect, there is provided the use of an exon skipping molecule and/or exon 12 retention molecule, viral vector or composition as defined herein for the preparation of a medicament, for the preparation of a medicament for treating a condition requiring modulating splicing of USH2A and for the preparation of a medicament for the prevention, treatment or delay of a USH2A related disease or condition. A preferred USH2A related disease or condition is Usher Syndrome type 2. Each feature of said use has earlier been defined herein.

A treatment in a use or in a method according to the invention is at least once, lasts one week, one month, several months, one year, 2, 3, 4, 5, 6 years or longer, such as lifelong. Each exon skipping molecule or exon skipping oligonucleotide or exon 12 retention molecule or equivalent thereof as defined herein for use according to the invention may be suitable for direct administration to a cell, tissue and/or an organ in vivo of individuals already affected or at risk of developing USH2A related disease or condition, and may be administered directly in vivo, ex vivo or in vitro. The frequency of administration of an oligonucleotide, composition, compound or adjunct compound of the invention may depend on several parameters such as the severity of the disease, the age of the patient, the mutation of the patient, the number of exon skipping molecules (i.e. dose), the formulation of said molecule, the route of administration and so forth. The frequency may vary between daily, weekly, at least once in two weeks, or three weeks or four weeks or five weeks or a longer time period.

Dose ranges of an exon skipping molecule or exon 12 retention molecule, preferably an oligonucleotide according to the invention are preferably designed on the basis of rising dose studies in clinical trials (in vivo use) for which rigorous protocol requirements exist. An exon skipping molecule or exon 12 retention molecule, preferably an oligonucleotide as defined herein, may be used at a dose which is ranged from 0.01 and 20 mg/kg, preferably from 0.05 and 20 mg/kg. A suitable intravitreal dose would be between 0.05 mg and 5 mg, preferably between 0.1 and 1mg per eye, such as about per eye: 0.1, 0.2, 0.3, 0.4, 0.5, 0.6, 0.7, 0.8, 0.9 or 1.0 mg.

In a preferred embodiment, a concentration of an oligonucleotide as defined herein, which is ranged from 0.1 nM and 1 µM is used. Preferably, this range is for in vitro use in a cellular model such as retina cells or retinal tissue. More preferably, the concentration used is ranged from 1 to 400 nM, even more preferably from 10 to 200 nM, even more preferably from 50 to 100 nM. If several oligonucleotides are used, this concentration or dose may refer to the total concentration or dose of oligonucleotides or the concentration or dose of each oligonucleotide added.

In a preferred embodiment, a viral vector, preferably an AAV vector as described earlier herein, as delivery vehicle for a molecule according to the invention, is administered in a dose ranging from $1 \times 10^9$-$1 \times 10^{17}$ virus particles per injection, more preferably from $1 \times 10^{10}$-$1 \times 10^{12}$ virus particles per injection.

The ranges of concentration or dose of oligonucleotide(s) as given above are preferred concentrations or doses for in vivo, in vitro or ex vivo uses. The skilled person will understand that depending on the oligonucleotide(s) used, the target cell to be treated, the gene target and its expression levels, the medium used and the transfection and incubation conditions, the concentration or dose of oligonucleotide(s) used may further vary and may need to be optimized any further.

An exon skipping molecule or exon 12 retention molecule according to the invention, or a viral vector according to the invention, or a composition according to the invention for use according to the invention may be suitable for administration to a cell, tissue and/or an organ in vivo of individuals already affected or at risk of developing a USH2A related disease or condition, and may be administered in vivo, ex vivo or in vitro. Said exon skipping molecule or exon 12 retention molecule according to the invention, or a viral vector according to the invention, or a composition according to the invention may be directly or indirectly administered to a cell, tissue and/or an organ in vivo of an individual already affected by or at risk of developing a USH2A related disease or condition, and may be administered directly or indirectly in vivo, ex vivo or in vitro. As Usher Syndrome type 2 has a pronounced phenotype in retina and inner ear cells, it is preferred that said cells are retina or inner ear cells, it is further preferred that said tissue is the retina or the inner ear and/or it is further preferred that said organ comprises or consists of the eye or the ear.

The invention further provides a method for modulating splicing of USH2A in a cell comprising contacting the cell, preferably a retina cell, with an exon skipping molecule and/or an exon 12 retention molecule according to the invention, or a viral vector according to the invention, or a composition according to the invention. The features of this aspect are preferably those defined earlier herein. Contacting the cell with an exon skipping molecule according to the invention, or a viral vector according to the invention, or a composition according to the invention may be performed by any method known by the person skilled in the art. Use of the methods for delivery of exon skipping molecules, an exon 12 retention molecule, viral vectors and compositions described herein is included. Contacting may be directly or indirectly and may be in vivo, ex vivo or in vitro.

The invention further provides a method for the treatment of a USH2A related disease or condition requiring modulating splicing of USH2A of an individual in need thereof, said method comprising contacting a cell, preferably a retina cell, of said individual with an exon skipping molecule and/or an exon 12 retention molecule according to the invention, or a viral vector according to the invention, or a composition according to the invention. The features of this aspect are preferably those defined earlier herein. Contacting the cell, preferably a retina cell with an exon skipping molecule according to the invention, or a viral vector according to the invention, or a composition according to the invention may be performed by any method known by the person skilled in the art. Use of the methods for delivery of molecules, viral vectors and compositions described herein is included. Contacting may be directly or indirectly and may be in vivo, ex vivo or in vitro, A preferred USH2A related disease or condition is Usher Syndrome type 2.

Unless otherwise indicated each embodiment as described herein may be combined with another embodiment as described herein.

As can be observed in the experimental section herein, at the RNA level, addition of various AONs targeting the aberrant USH2A pseudoexon indeed resulted in exclusion of the USH2A pseudoexon from the pseudoexon containing rhodopsin construct. AONs are postulated to restore aberrant splicing in patient cells or cell lines as well, coinciding with an increased synthesis of the wild-type USH2A protein.

In nasal cells, USH2A is abundantly expressed. Therefore, it is postulated that addition of AONs according to the invention to cultured nasal cells from PE40 patients will result in an increased amount of wild-type USH2A protein that is detectable on Western blot, and as such will demonstrate that AON-based therapy will not only restore normal splicing of USH2A pseudoexon constructs at least to some extent, but also results in restoring USH2A PE40 mRNA and results in restoring USH2A protein function.

Definitions

In this document and in its claims, the verb "to comprise" and its conjugations is used in its non-limiting sense to mean that items following the word are included, but items not specifically mentioned are not excluded. In addition, reference to an element by the indefinite article "a" or "an" does not exclude the possibility that more than one of the element is present, unless the context clearly requires that there be one and only one of the elements. The indefinite article "a" or "an" thus usually means "at least one". The word "about" or "approximately" when used in association with a numerical value (e.g. about 10) preferably means that the value may be the given value (of 10) more or less 0.1% of the value.

The sequence information as provided herein should not be so narrowly construed as to require inclusion of erroneously identified bases. The skilled person is capable of identifying such erroneously identified bases and knows how to correct for such errors. In case of sequence errors, the sequence of the polypeptide obtainable by expression of the gene present in SEQ ID NO: 1 containing the nucleic acid sequence coding for the polypeptide should prevail.

All patent and literature references cited in the present specification are hereby incorporated by reference in their entirety.

FIGURE LEGENDS

FIG. 1: Principle of AON-based therapy for USH2A PE40 a) Normal USH2A mRNA splicing of exons 40 and 41, resulting in wild-type USH2A protein.

b) The deep intronic USH-causing mutation is an A-to-G transition (underlined and indicated with an asterisk) in intron 40 of USH2A. This mutation creates a splice donor site, which results in the inclusion of an aberrant exon to the USH2A mRNA and subsequent premature termination of the USH2A protein.

c) Upon binding of sequence-specific AONs, factors involved in splicing will not recognize the aberrant splice donor site in intron 40, resulting in redirection of normal USH2A splicing and synthesis of a correct USH2A protein.

Figure 2B:
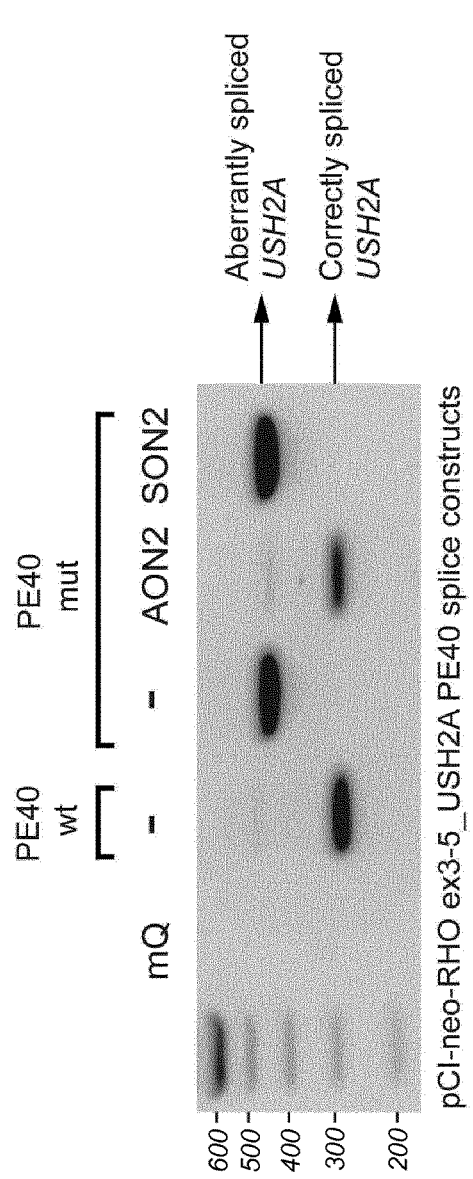

FIG. 2: AON-induced skipping of USH2A PE40 a) RT-PCR analysis of RHO ex3-USH2A PE40 wildtype/mutant-RHO ex5 mRNA's isolated from transfected HEK293T cells that were cultured in the absence or presence of AON1 or AON2 directed against the aberrant USH2A PE40 exon in a final concentration of 1.0 µM. The upper band represents the aberrant RHO-USH2A PE40 splice product, whereas the lower band represents the "corrected" transcript without USH2A PE40. MQ: negative water control.

b) Specificity of AON-based rescue. Similar to A), cells were co-transfected with pCI-neo-RHO ex3-5_USH2A PE40 wildtype/mutant and AON2, or a sense oligonucleotide directed to the same target site (SON2). RT-PCR reaction using primers located in RHO exon 3 and exon 5.

Figure 3A:
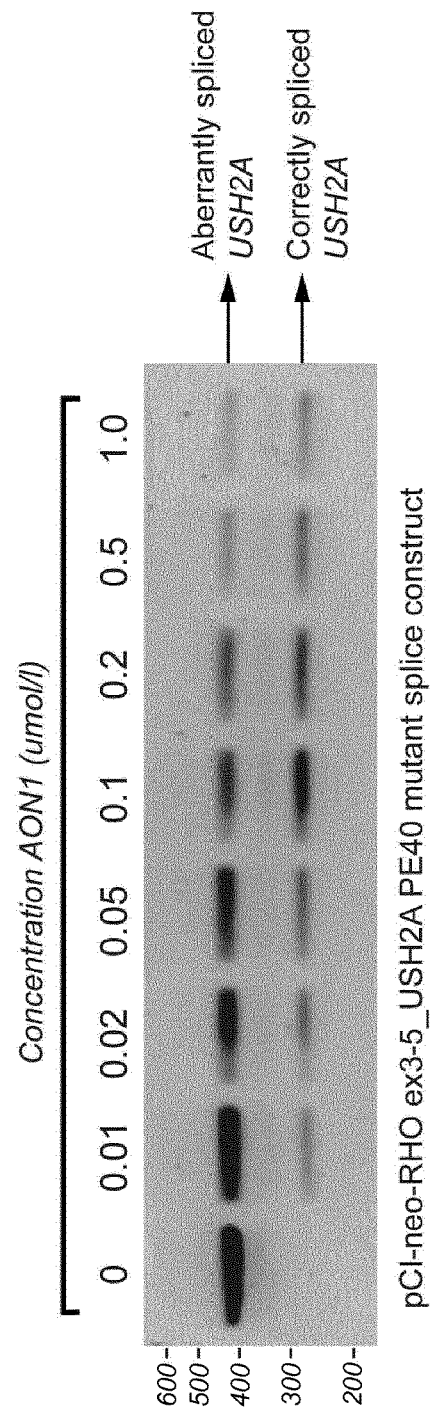
Figure 3B:
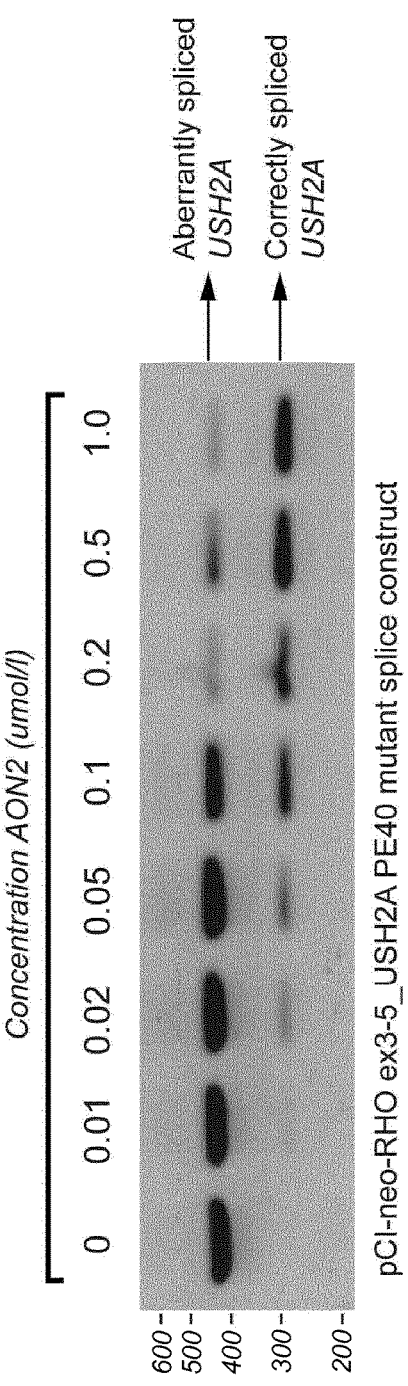
Figure 3C:
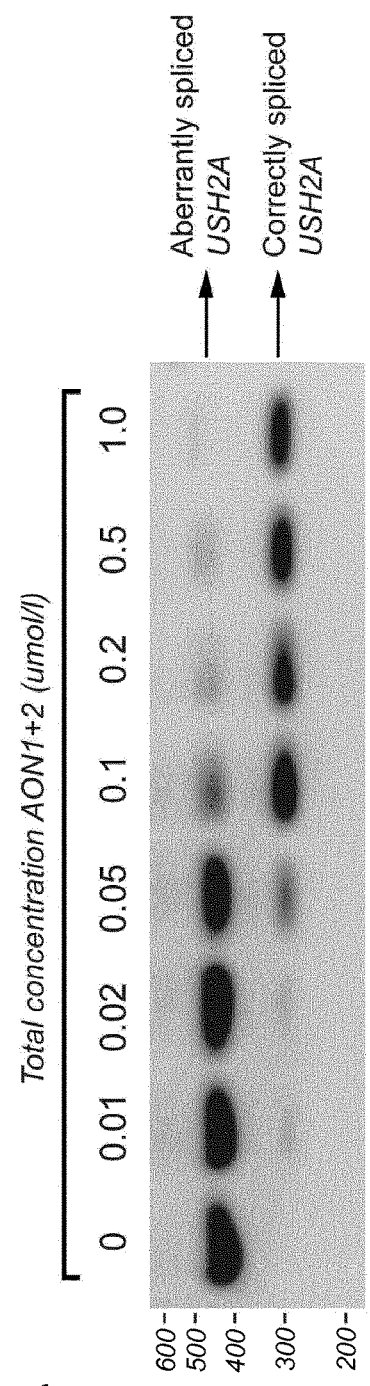

FIG. 3: Titration curves for the AONs directed against USH2A PE40

RT-PCR analysis of RHO ex3-USH2A PE40 mutant-RHO ex5 mRNA's isolated from transfected HEK293T cells that were cultured in the absence or presence of different total concentrations of AON1 (a), AON2 (b) or AON1+2 (c), ranging from 0 to 1.0 µM. Primers were located in RHO exon 3 and exon 5. The upper band represents the aberrant RHO-USH2A PE40 splice product, whereas the lower band represents the "corrected" transcript without USH2A PE40.

FIG. 4: AON-induced skipping of USH2A exon13 and exon50 a) RT-PCR analysis of RHO ex3-USH2A exon13-RHO ex5 mRNA's isolated from transfected HEK293T cells that were cultured in the absence or presence of AON1 or AON2 directed against USH2A exon13 in a final concentration of 1.0 µM. Primers were located in RHO exon 3 and exon 5. The upper band represents the RHO-USH2A exon13 splice product, whereas the lower band represents the "corrected" transcript without USH2A exon13. When applied alone, addition of AON1 or 2 also gives rise to a transcript containing partially skipped exon13. Application of a combination of AON1+2 results in the skipping of complete exon13.

b) Similar to (a), cells were co-transfected with pCI-neo-RHO ex3-5 USH2A exon50 and AON1 or AON2 directed against USH2A exon50 in a final concentration of 1.0 µM. The upper band represents the RHO-USH2A exon50 splice product, whereas the lower band represents the "corrected" transcript without USH2A exon50. AON1 seems not to have major exon skipping potential but enhances the skipping potential of AON2 when applied in combination with AON2.

Figure 5:
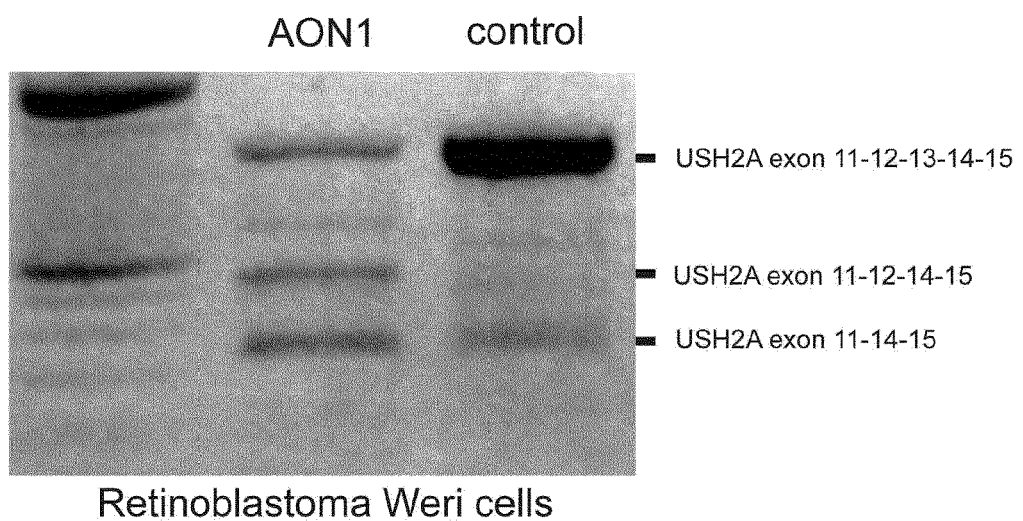

FIG. 5: AON-induced skipping of USH2A exon13 in retinoblastoma Weri cells

RT-PCR analysis of USH2A mRNA isolated from retinoblastoma Weri cells that were cultured in the absence or presence of AON1 directed against USH2A exon13 in a final concentration of 1.0 µM. The upper band represents the USH2A wild-type splice product, whereas the lower band represents the transcript lacking USH2A exon12 and 13. Application of AON1 results in the skipping of complete exon13 in approximately 50% of the transcripts.

Figure 6A:
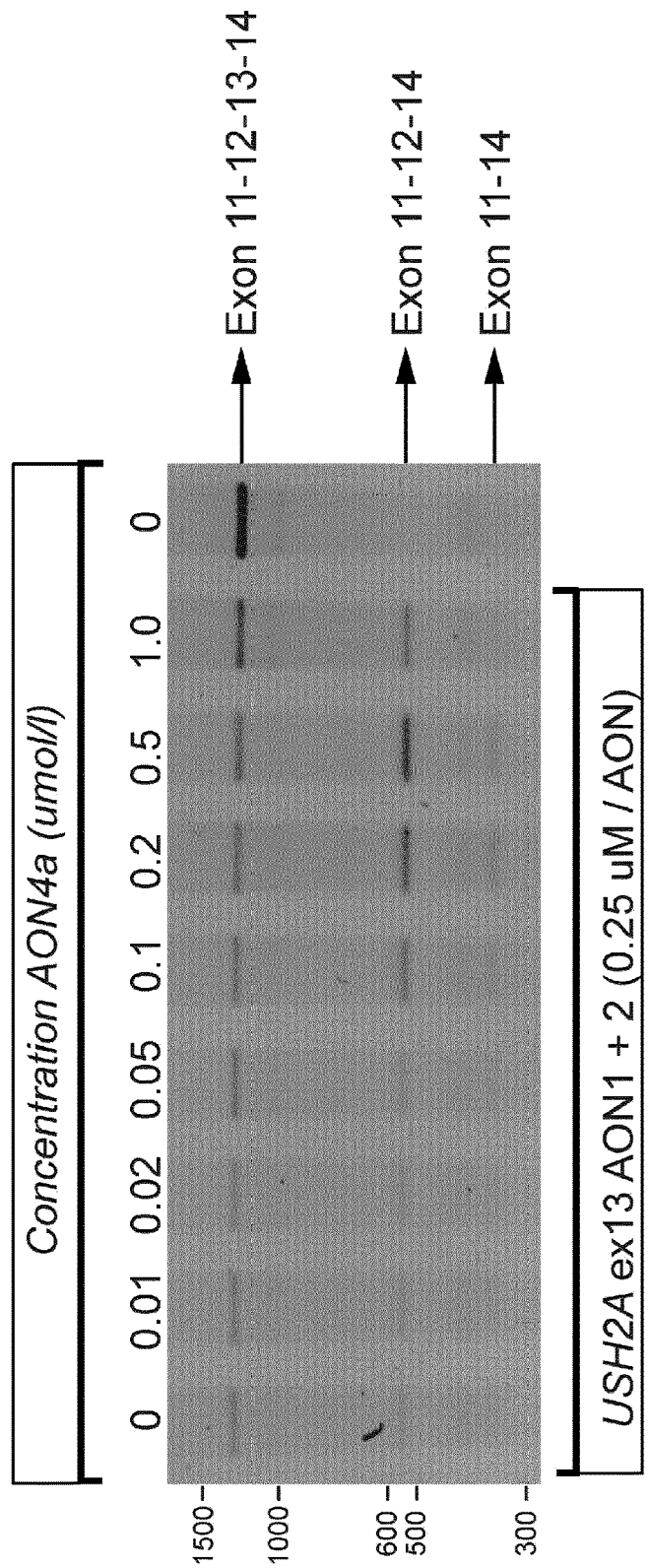

FIG. 6A, B: AON-induced retention of USH2A exon12 in retinoblastoma Weri cells

RT-PCR analysis of USH2A mRNA isolated from retinoblastoma Weri cells that were cultured in the absence or presence of various concentrations of AON4a (SEQ ID No; 39) directed against intronic splice silencer (ISS) sites in USH2A intron12, combined with AON1+2 (SEQ ID NO: 15 and 16) directed against USH2A exon13 (both at a concentration of 0.25 µM). The upper band represents the USH2A wild-type splice product, the middle band represents the transcript lacking USH2A exon13, whereas the lower band represents the transcript lacking USH2A exon12 and 13. Application of increasing amounts of AON4a (SEQ ID NO: 39) results in the retention of exon12 in the USH2A transcript (A). Quantification of the exon12 retention was determined by assessing the ratio of the intensity of the wildtype fragment and the fragment lacking exon13 (B). The optimal dose for AON4a (SEQ ID NO: 39) in the current experiment is approximately in between 0.1 and 0.5 µM.

FIG. 7: Skipping of USH2A PE40 by rAAV-based AON delivery

RT-PCR analysis of RHO ex3-USH2A PE40 wildtype/ mutant-RHO ex5 mRNA's isolated from transfected HEK293T cells that were cultured in the absence or presence of 1.0 µg pSMD2-U7-USH2A PE40-AON1 (SEQ ID NO: 42) or pSMD2-U7-USH2A PE40-AON2 (SEQ ID NO: 43) directed against the aberrant USH2A PE40 exon. As a negative control, 1.0 µg of the pSMD2-U7-USH2A PE40-SON2 (SEQ ID NO: 44) was transfected. The upper band represents the aberrant RHO-USH2A PE40 splice product, whereas the lower band represents the "corrected" transcript without USH2A PE40.

EXAMPLES

Material and Methods
Design Antisense Oligonucleotides

The sequence of USH2A PE40, exon 13 and exon 50 was analyzed for the presence of exonic splice enhancer motifs (SC35 type) using the ESE finder 3.0 program (http://rulai.cshl.edu/cgibin/tools/ESE3/esefinder.cgi?process=home). RNA antisense oligonucleotides were purchased from Eurogentec, and designed with a Tm of 58° C., and modified with a 2'-0-methyl group at the sugar chain and a phosphothioate backbone, and dissolved in phosphate buffered saline.

Minigene Splice Constructs

A pCI-NEO-based plasmid containing the genomic region encompassing exons 3-5 of RHO was used to test the efficiency of the used AONs in in vitro splicing assays (Gamundi et al, 2008). For this purpose RHO exon4 and part of the flanking intronic sequences is replaced by human USH2A exon13, exon50 or pseudoexon40 (PE40) together with 500 bp of 5' and 3' flanking intronic sequence using Gateway cloning technology (Invitrogen).

Cell Culture

HEK293T cells were cultured in DMEM medium (Gibco) containing 10% (v/v) fetal calf serum (Sigma), 1% 10 U/µl penicillin and 10 µg/µl streptomycin (Gibco), at a density of 0.5×10⁶ cells/ml. Cells were passaged twice a week. Human retinoblastoma cells (Rb-Weri) were cultured in RPMI1640 medium (Gibco) containing 10% (v/v) fetal calf serum (Sigma), 1% 10 U/µl penicillin and 10 µg/µl streptomycin (Gibco), and 1% GlutaMAX (Gibco), at a density of 0.5×10⁶ cells/ml. Cells were passaged twice a week.

Transfection of AONs in Retinoblastoma Weri Cells

Prior to transfection, 1.0×10⁶ cells were seeded in each well of a 6-wells plate, in a total volume of 0.9 ml Optimem. Transfection mixtures were prepared by combining 50 µl Optimem supplemented with 1 µl AON in a desired concentration and 50 µl Optimem supplemented with 1.25 µl Lipofectamine 2000 (Invitrogen). Incubate both mixtures for 5' at room temperature. After this incubation step add both mixtures together, mix well and incubate for another 20' at room temperature, before addition to the cells. Forty-eight hours after transfection, cells were collected and washed with 1×PBS, before directly proceeding to RNA isolation.

Co-transfection of AONs and Minigene Splice Constructs in HEK293T Cells

A day before transfection, 1.0×10⁶ cells were seeded in each well of a 6-wells plate, in a total volume of 0.9 ml complete medium. Transfection mixtures were prepared by combining 1 µl AON in a desired concentration, 9 µl (=500 ng) of plasmid DNA and 90 µl transfection reagent (PEI), and incubated at room temperature for 10 minutes, before addition to the cells. Forty-eight hours after transfection, cells were collected and washed with 1×PBS, before directly proceeding to RNA isolation.

Generation of pSMD2-U7 snRNA Plasmids

By adopting the method of fusion PCR, USH2A PE40 AON1, AON2 and SON2 were cloned into the pSMD2-U7 snRNA vector. In short, for obtaining the left fragment the AAV-XbaI forward primer (SEQ ID NO: 45) was combined with the U7-AON1/2/SON2 reverse primer (SEQ ID NO:'s 47, 49 and 51, respectively) and for obtaining the right fragment the U7-AON1/2/SON2 forward primer (SEQ ID NO:'s 48, 50 and 52, respectively) was combined with the AAV-NheI reverse primer (SEQ ID NO: 46) using the empty pSMD2-U7 snRNA vector as a template. In a second PCR both fragments are fused together and amplified using the AAV-XbaI forward primer (SEQ ID NO: 45) and the AAV-NheI reverse primer (SEQ ID NO: 47). The resulting fragment and the empty pSMD2-U7 snRNA vector were subsequently digested with XbaI and NheI, after which the digested fragment was ligated into the pSMD2-U7 snRNA vector. The resulting plasmids (pSMD2(AAV)U7snRNA_hUSH2A PE40 AON1 (SEQ ID NO: 42), pSMD2(AAV)U7snRNA_hUSH2A PE40 AON2 (SEQ ID NO: 43 and pSMD2(AAV)U7snRNA_hUSH2A PE40 SON2 (SEQ ID NO: 44)) were sequence verified.

Co-transfection of pSMD2-AON and Minigene Splice Constructs in HEK293T Cells

A day before transfection, 1.0×10⁶ cells were seeded in each well of a 6-wells plate, in a total volume of 0.9 ml complete medium. Transfection mixtures were prepared by combining 1 µg of pSMD2-AON plasmid DNA, 1 µg of USH2A PE40 minigene splice construct DNA and 90 µl transfection reagent (PEI), and incubated at room temperature for 10 minutes, before addition to the cells. Forty-eight hours after transfection, cells were collected and washed with 1×PBS, before directly proceeding to RNA isolation.

RNA Isolation and RT-PCR

Total RNA was isolated from transfected HEK293T or retinoblastoma Weri cells using the Nucleospin RNA II isolation kit (Machery Nagel), according to manufacturer's protocol. Subsequently, 1 µg of total RNA was used for cDNA synthesis using the iScript cDNA synthesis kit (Bio-Rad). Five percent of the cDNA was used for each PCR reaction. For the minigene splice assays, part of the cDNA was amplified under standard PCR conditions, and using forward primer 5'-cggaggtcaacaacgagtct-3' (SEQ ID NO: 34) and reverse primer 5'-aggtgtaggggatgggagac-3' (SEQ ID NO: 35) that are located in exon 3 and exon 5 of the human RHO gene, respectively. For the Rb-Weri exon skipping experiments, part of the USH2A cDNA was amplified under standard PCR conditions using forward primer 5'-aagttggtgcagatccttcg-3' (SEQ ID NO: 36) and reverse primer 5'-agaaacactggcctgtgacc-3' (SEQ ID NO: 37) that are located in exon 11 and exon 15 of the human USH2A gene, respectively. PCR products were resolved on a 1.5% agarose gel. Bands presumably representing correctly and aberrantly spliced USH2A were excised from the gel, purified using Nucleospin Extract II isolation kit and sequenced from both strands with the ABIPRISM Big Dye Terminator Cycle Sequencing V2.0 Ready Reaction kit and the ABIPRISM 3730 DNA analyzer (Applied Biosystems).

Results

The intronic USH2A mutation (c.7595-2144A>G) creates a cryptic splice donor site that results in the inclusion of an aberrant exon (PE40) into the USH2A mRNA (FIG. 1A,B). Addition of AONs directed against the aberrant exon would prevent the insertion of this exon by preventing the binding of factors that are essential for splicing such as the U1- and U2 snRNP complexes, and serine-arginine rich proteins, thereby restoring normal USH2A splicing and protein synthesis (FIG. 1C). AONs can target splice sites as well as exonic sequences, although in the particular case of the Duchenne muscular dystrophy (DMD) gene, AONs targeting exonic regions tend to outperform those that target the splice sites (Aartsma-Rus et al, 2010). In addition, previous studies have suggested a positive correlation between the capability of AONs to induce exon skipping and the presence of predicted SC35 splice factor binding sites in the target sequence (Aartsma-Rus et al, 2008). To design an AON with high exon-skipping potential, the aberrant USH2A exon (152 nucleotides exonic sequence plus 15 nucleotides of intronic sequence on each side) was scrutinized for exonic splice enhancer binding motifs, using the ESE finder 3.0 program (Smith et al, 2006). Within the aberrant exon, two regions with respectively three and two SC35-binding motifs were predicted (data not shown). Hence, two AONs were designed such that it encompassed these regions with SC35 motifs (designated AON1, SEQ ID NO: 10; and AON2, SEQ ID NO: 11), and being complementary to the USH2A mRNA. To determine whether AONs 1 and 2 have exon-skipping potential in vitro, HEK293T cells transfected with a pCI-neo based minigene containing the genomic region encompassing RHO exon 3-USH2A PE40 wild-type/mutant-RHO exon5 were cultured in the presence or absence of 1 µM AON1 and AON2. As expected in the wild-type situation, PE40 is not incorporated in the transcript. In the mutant situation, PE40 is recognized as an exon and therefore incorporated in the transcript. Upon addition of either AON1 or AON2, a strong decrease in aberrantly spliced transcripts was noted (FIG. 2, upper panel). In this condition, AON2 appeared to be the most potent AON. Next, the specificity of AON2 was assessed by transfecting a sense oligonucleotide directed to the same target site (SON2, SEQ ID NO: 25). RT-PCR analysis performed after the minigene splice assay showed that in the cells transfected with SON2, only the aberrantly spliced RHO-USH2A PE40 mRNA molecules are still present (FIG. 2, lower panel), demonstrating the specificity of the antisense sequence. Interestingly, the decrease in aberrantly spliced transcripts appears to coincide with an increased intensity of the product representing correctly spliced mRNA. These data indicate that the aberrant product is not degraded, but that the AON transfection truly induces exon skipping, eventually resulting in the synthesis of more correctly spliced wild-type USH2A mRNA.

To determine the effective dose of AON1 and 2 in minigene splice assays, cells were co-transfected with various concentrations of AON1, 2 and 1+2, ranging from a total concentration of 0.01 to 1.0 µM. Even at the lowest concentration of 0.01 µM, a marked reduction in aberrantly spliced USH2A was observed for AON1 (FIG. 3). A maximum amount of exon skipping was still observed at 0.1 µM of AON, indicating that this concentrations is sufficient to convert more than half of the aberrantly spliced USH2A (FIG. 3).

Next we evaluated the USH2A PE40 skipping potential of AONs 1 and 2 when delivered using an AAV-based delivery method. For this purpose the AON1, 2 and SON2 sequences were cloned in the pSMD2-U7 snRNA plasmid, targeting the expression of AONs directly to the spliceosome. HEK293T cells were transfected with a mixture containing 1 µg of pSMD2-AON plasmid DNA and 1 µg of USH2A PE40 minigene splice construct DNA. Forty-eight hours after transfection, cells were collected and washed with 1×PBS, before directly proceeding to RNA isolation. Upon addition of either pSMD2-U7 snRNA-AON1 or -AON2, a strong decrease in aberrantly spliced transcripts was noted (FIG. 7). In this condition, AON1 appeared to be the most potent AON, in contrast to the naked AONs delivery.

RT-PCR analysis performed after co-transfection of pSMD2-U7 snRNA-SON2 with the USH2A PE40 minigene splice construct showed that only the aberrantly spliced RHO-USH2A PE40 mRNA molecules are still present (FIG. 7), demonstrating the specificity of the antisense sequence. AAV-based delivery of AONs capable of redirecting USH2A PE40 splicing appears to be potent as well.

Figure 4A:
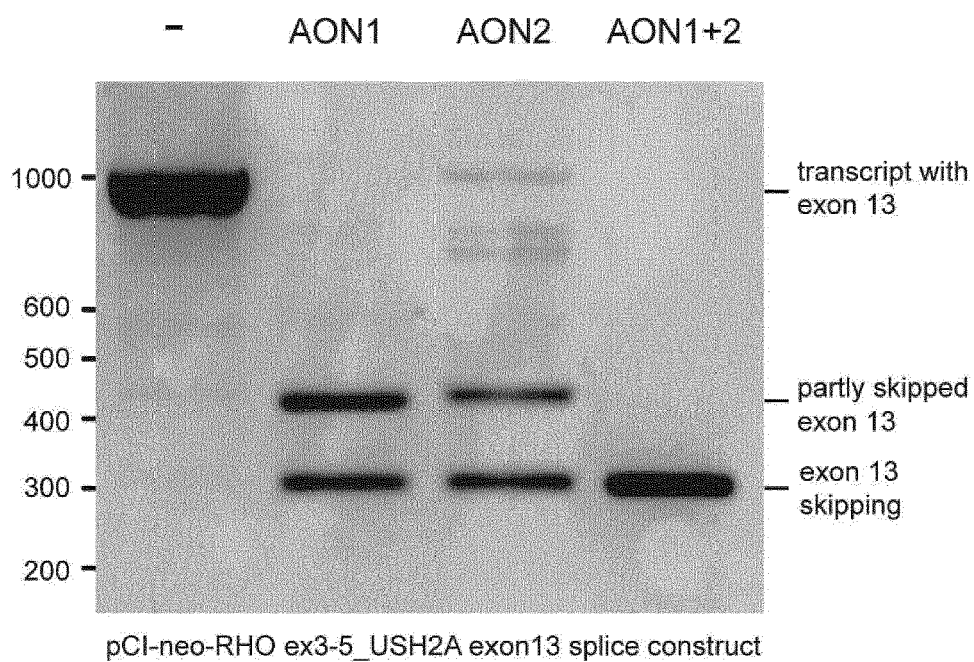
Figure 4B:
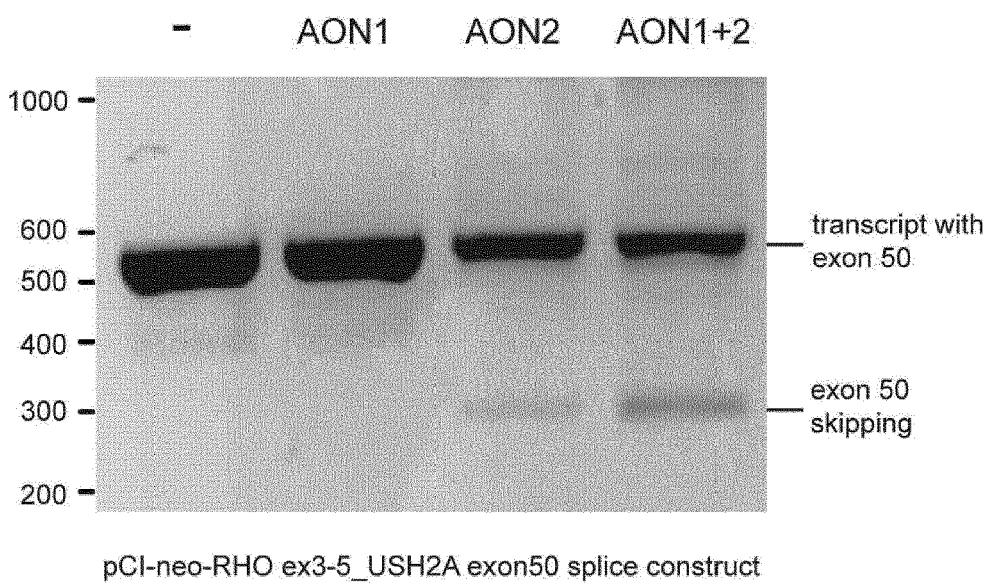

Another way to use AON-treatment is to skip exons that carry (protein-truncating) mutations in such a way, that the reading frame of the mRNA remains intact and a (partially) functional protein is made. Two frequently mutated exons in the USH2A gene that fulfill the criteria for exon skipping are exon 13 and exon 50 (Table 2 and 3). For both exons we designed two AONs using the settings described above. In vitro splicing assays were performed using a pCI-neo based minigene that contained, besides the genomic region around RHO exon3-5, USH2A exon 13 or exon 50 surrounded by 500 bp of intronic sequence. During these minigene splice assays HEK293T cells were co-transfected with a final concentration of 1.0 µM AON1, AON2 or AON1+2. Addition of AON1 (SEQ ID NO: 15) and AON2 (SEQ ID NO: 16) directed against two different regions containing SC35 motifs in USH2A exon13 resulted in the partial or complete skipping of exon13. Combination of AONs 1+2 resulted in the complete skipping of exon13 in nearly 100% of the transcripts (FIG. 4A). A similar assay using AON1 (SEQ ID NO: 17) and AON2 (SEQ ID NO: 18) directed against USH2A exon 50 was performed. Interestingly, AON2 resulted in relatively low levels of exon skipping. In contrast, AON1 hardly showed any exon skipping potential (FIG. 4B). These data demonstrate the sequence specificity in AON-based exon skipping of USH2A exon 50. Supplementing AON2 with AON1 increased the skipping potential of the former (FIG. 4B).

Finally, RT-PCR analysis revealed the expression of USH2A in retinoblastoma Weri cells (FIG. 5). Using a forward primer located in exon 11 and a reverse primer in exon 15 we identified a naturally occurring combined skipping of exon 12 and 13. Culturing retinoblastoma Weri cells in the presence of 1.0 µM AON1 (SEQ ID NO: 15) directed against USH2A exon 13 resulted in the skipping of exon 13 in approximately 50% of the transcripts, indicative for a possible therapeutic potential.

Figure 6B:
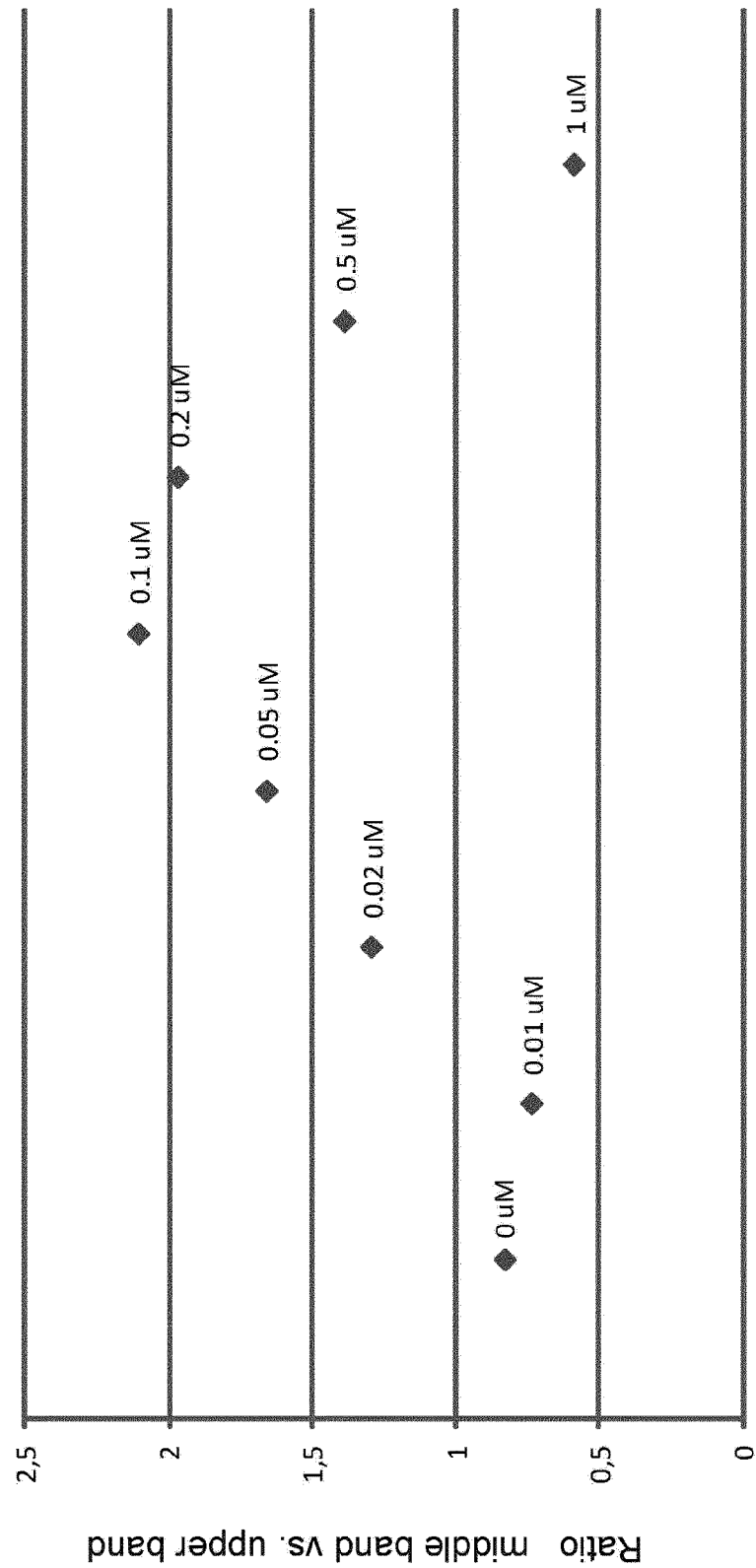

In order to prevent the AON-induced skipping of exon12, we designed AON4a (SEQ ID NO: 39) directed against intronic splice silencer sites (ISS) in intron 12 and evaluated its effect in retinoblastoma Weri cells. For this, a combination of 0.25 µM AON1 (SEQ ID NO: 15), 0.25 µM AON2 (SEQ ID NO: 16) and various amounts of AON4a (ranging from 0-1.0 µM; FIG. 6B) were transfected. RT-PCR analysis analysis and subsequent quantification of the results revealed that application of increasing amounts of AON4a results in the retention of exon 12 in the USH2A transcript (FIG. 6A). Quantification of the exon 12 retention was performed by assessing the ratio of the intensity of the wildtype fragment and the fragment lacking exon 13 (FIG. 6B). The optimal dose for AON4a in the current experiment was approximately in between 0.1 and 0.5 µM. A combination of AONs 1, 2 and 4a is therefore quite effective.

TABLE 1

Sequences

| SEQ ID NO: | Name: |
|---|---|
| 1 | Wild-type USH2A coding DNA |
| 2 | PE40 USH2A coding DNA |
| 3 | Wild-type USH2A protein |
| 4 | PE40 USH2A protein (putative) |
| 5 | pseudoexon coding DNA |
| 6 | pseudoexon protein sequence |
| 7 | intron 40 genomic DNA |
| 8 | USH2A genomic DNA wild-type |
| 9 | USH2A genomic DNA PE40 |
| 10 | AON1-PE40 |
| 11 | AON2-PE40 |
| 12 | pseudoexon 40 and flanking sequences DNA |
| 13 | exon 13 and flanking sequences DNA |
| 14 | exon 50 and flanking sequences DNA |
| 15 | AON1-exon13 |
| 16 | AON2-exon13 |
| 17 | AON1-exon50 |
| 18 | AON2-exon50 |
| 19 | AON1-PE40 target site and flanking sequences (+10 nt) |
| 20 | AON2-PE40 target site and flanking sequences (+10 nt) |
| 21 | AON1-exon13 target site and flanking sequences (+10 nt) |
| 22 | AON2-exon13 target site and flanking sequences (+10 nt) |
| 23 | AON1-exon50 target site and flanking sequences (+10 nt) |
| 24 | AON2-exon50 target site and flanking sequences (+10 nt) |
| 25 | SON2-PE40 |
| 26 | AON1-PE40 target site and flanking sequences (+5 nt) |
| 27 | AON2-PE40 target site and flanking sequences (+5 nt) |
| 28 | AON1-exon13 target site and flanking sequences (+5 nt) |
| 29 | AON2-exon13 target site and flanking sequences (+5 nt) |
| 30 | AON1-exon50 target site and flanking sequences (+5 nt) |
| 31 | AON2-exon50 target site and flanking sequences (+5 nt) |
| 32 | exon 13 DNA sequence |
| 33 | exon 50 DNA sequence |
| 34 | Rho exon 3 FW PCR primer |
| 35 | Rho exon 5 REV PCR primer |
| 36 | USH2A exon 11 FW PCR primer |
| 37 | USH2A exon 14 REV PCR primer |
| 38 | Wild-type USH2A Exon 11 - Exon 13 genomic DNA |
| 39 | AON4a-exon 12 |
| 40 | AON4a-exon 12 target site and flanking sequences (+10 nt) |
| 41 | AON4a-exon 12 target site and flanking sequences (+5 nt) |
| 42 | pSMD2(AAV)U7snRNA_hUSH2A PE40 AON1 |
| 43 | pSMD2(AAV)U7snRNA_hUSH2A PE40 AON2 |
| 44 | pSMD2(AAV)U7snRNA_hUSH2A PE40 SON2 |
| 45 | AAV XbaI FW PCR primer |
| 46 | AAV NheI REV PCR primer |
| 47 | U7 + AON1 REV PCR primer |
| 48 | U7 + AON1 FW PCR primer |
| 49 | U7 + AON2 REV PCR primer |
| 50 | U7 + AON2 FW PCR primer |
| 51 | U7 + SON2 REV PCR primer |
| 52 | U7 + SON2 FW PCR primer |

REFERENCES

Lentz et al., Nat Med. 2013 March; 19(3):345-50. doi: 10.1038/nm.3106. Epub 2013 Feb. 4.

Vaché et al., Hum Mutat. 2012 January; 33(1):104-8. doi: 10.1002/humu.21634. Epub 2011 Nov. 16.

Friesen and Darby, Nature Structural Biology 5: 543-546 (1998).

Dorn and Kippenberger, Curr Opin Mol Ther 2008 10(1) 10-20.

Nielsen, et al. (1991) Science 254, 1497-1500.

Govindaraju and Kumar (2005) Chem. Commun, 495-497.

Egholm et al (1993) Nature 365, 566-568.

Morita et al. 2001. Nucleic Acid Res Supplement No. 1: 241-242.

Gorman L, et al, Stable alteration of pre-mRNA splicing patterns by modified U7 small nuclear RNAs. Proc Natl Acad Sci USA 1998; 95(9):4929-34.

Suter D, et al, Double-target antisense U7 snRNAs promote efficient skipping of an aberrant exon in three human beta-thalassemic mutations. Hum Mol Genet 1999; 8(13): 2415-23.

Remington: The Science and Practice of Pharmacy, 20th Edition. Baltimore, Md.: Lippincott Williams k Wilkins, 2000.

Kimberling W J, Hildebrand M S, Shearer A E, Jensen M L, Halder J A, Trzupek K, Cohn E S, Weleber R G, Stone E M, Smith R J. Frequency of Usher syndrome in two pediatric populations: implications for genetic screening of deaf and hard of hearing children (2010) Genet Med 12:512-516.

Hartong D T, Berson E L,. Dryja T P. Retinitis pigmentosa (2006) Lancet, 368(9549): 1795-1809.

McGee T L, Seyedahmadi B J, Sweeney M O et al, Novel mutations in the long isoform of the USH2A gene in patients with Usher syndrome type II or nonsyndromic retinitis pigmentosa (2010) J. Med. Genet., 47(7):499-506.

VachéC, Besnard T, le Berre P, Garcia-Garcia G, Baux D, Larrieu L, Abadie C, Blanchet C, Bolz H J, Millan J, Hamel C, Malcolm S, Claustres M, Roux A F. Usher syndrome type 2 caused by activation of an USH2A pseudoexon: implications for diagnosis and therapy. Human Mutation (2012) 33(1):104-8.

Bainbridge, J. W., Smith, A. J., Barker, S. S., Robbie, S., Henderson, R., Balaggan, K., Viswanathan, A., Holder, G. E., Stockman, A., Tyler, N. et al (2008). Effect of gene therapy on visual function in Leber's congenital amaurosis. N Engl J Med 358, 2231-2239.

Cideciyan, A. V., Aleman, T. S., Boye, S. L., Schwartz, S. B., Kaushal, S., Roman, A. J., Pang, J. J., Sumaroka, A., Windsor, E. A., Wilson, J. M. et al (2008). Human gene therapy for RPE65 isomerase deficiency activates the retinoid cycle of vision but with slow rod kinetics. Proc Natl Acad Sci USA 105, 15112-15117.

Hauswirth, W., Aleman, T. S., Kaushal, S., Cideciyan, A. V., Schwartz, S. B., Wang, L., Conlon, T., Boye, S. L., Flotte, T. R., Byrne, B. et al (2008). Phase I Trial of Leber Congenital Amaurosis due to Estrada-Mutations by Ocular Subretinal Inj ection of Adeno-Associated Virus Gene Vector: Short-Term Results. Hum Gene Ther Maguire, A. M., Simonelli, F., Pierce, E. A., Pugh, E. N., Jr., Mingozzi, F., Bennicelli, J., Banfi, S., Marshall, K. A., Testa, F., Surace, E. M. et al (2008). Safety and efficacy of gene transfer for Leber's congenital amaurosis. N Engl J Med 358, 2240-2248.

Hashimoto T, Gibbs D, Lillo C, Azarian S M, Legacki E, Zhang X M, Yang X J, Williams D S. Lentiviral gene replacement therapy of retinas in a mouse model for Usher syndrome type 1B (2007) Gene Ther. 14(7):584-94.

Lopes V S, Boye S E, Louie C M, Boye S, Dyka F, Chiodo V, Fofo H, Hauswirth W W, Williams D S. Retinal gene therapy with a large MYO7A cDNA using adeno-associated virus (2013) Gene Ther. 20(8):824-33.

Colella P, Trapani I, Cesi G, Sommella A, Manfredi A, Puppo A, Iodice C, Rossi S, Simonelli F, Giunti M, Bacci M L, Auricchio A. Efficient gene delivery to the cone-enriched pig retina by dual AAV vectors (2014) Gene Ther. 21(4):450-6.

Zallocchi M, Binley K, Lad Y, Ellis S, Widdowson P, Iqball S, Scripps V, Kelleher M, Loader J, Miskin J, Peng Y W, Wang W M, Cheung L, Delimont D, Mitrophanous K A, Cosgrove D. EIAV-based retinal gene therapy in the shaker1 mouse model for usher syndrome type 1B: development of UshStat (2014) PLoS One 9(4):e94272.

Scaffidi P, Misteli T, Reversal of the cellular phenotype in the premature aging disease Hutchinson-Gilford progeria syndrome (2005) Nat.Med., 11(4):440-445.

Cirak S, Feng L, Anthony K et al, Restoration of the Dystrophin-associated Glycoprotein Complex After Exon Skipping Therapy in Duchenne Muscular Dystrophy (2011) Mol. Ther., Cirak S, rechavala-Gomeza V, Guglieri M et al, Exon skipping and dystrophin restoration in patients with Duchenne muscular dystrophy after systemic phosphorodiamidate morpholino oligomer treatment: an open-label, phase 2, dose-escalation study (2011) Lancet, 378 (9791):595-605.

Goemans N M, Tulinius M, van den Akker J T et al, Systemic administration of PRO051 in Duchenne's muscular dystrophy (2011) N.Engl. J. Med., 364(16): 1513-1522.

Gamundi M J, Hernan I, Muntanyola M et al, Transcriptional expression of cis-acting and trans-acting splicing mutations cause autosomal dominant retinitis pigmentosa (2008) Hum. Mutat., 29(6):869-878.

Aartsma-Rus, A., Houlleberghs, H., van Deutekom, J. C., van Ommen, G. J., and 't Hoen, P. A. Exonic sequences provide better targets for antisense oligonucleotides than splice site sequences in the modulation of Duchenne muscular dystrophy splicing (2010) Oligonucleotides 20, 69-77.

Aartsma-Rus, A., van, V. L., Hirschi, M., Janson, A. A., Heemskerk, H., de Winter, C. L., de, K. S., van Deutekom, J. C., 't Hoen, P. A., and van Ommen, G. J. Guidelines for Antisense Oligonucleotide Design and Insight Into Splice-modulating Mechanisms (2008) Mol Ther.

Smith, P. J., Zhang, C., Wang, J., Chew, S. L., Zhang, M. Q., and Krainer, A. R. An increased specificity score matrix for the prediction of SF2/ASF specific exonic splicing enhancers (2006) Hum Mol Genet 15, 2490-2508.

Garcia-Garcia G, Aparisi M J, Jaijo T, Rodrigo R, Leon A M, Avila-Fernandez A, Blanco-Kelly F, Bernal S, Navarro R, Diaz-Llopis M, Baiget M, Ayuso C, Millan J M, Aller E. Mutational screening of the USH2A gene in Spanish USH patients reveals 23 novel pathogenic mutations. (2011) Orphanet J Rare Dis. 6:65

Dreyer B, Brox V, Tranebjaerg L, Rosenberg T, Sadeghi A M, Möller C, Nilssen O. Spectrum of USH2A mutations in Scandinavian patients with Usher syndrome type II. (2008) Hum Mutat. 29(3):451.

McGee T L, Seyedahmadi B J, Sweeney M O, Dryja T P, Berson E L. Novel mutations in the long isoform of the USH2A gene in patients with Usher syndrome type II or non-syndromic retinitis pigmentosa. (2010) J Med Genet. 47(7):499-506.

Le Quesne Stabej P, Saihan Z, Rangesh N, Steele-Stallard H B, Ambrose J, Coffey A, Emmerson J, Haralambous E, Hughes Y, Steel K P, Luxon L M, Webster A R, Bitner-Glindzicz M. Comprehensive sequence analysis of nine Usher syndrome genes in the UK National Collaborative Usher Study. (2012) J Med Genet. 49(1):27-36.

Baux D, Larrieu L, Blanchet C, Hamel C, Ben Salah S, Vielle A, Gilbert-Dussardier B, Holder M, Calvas P, Philip N, Edery P, Bonneau D, Claustres M, Malcolm S, Roux A F. Molecular and in silico analyses of the full-length isoform of usherin identify new pathogenic alleles in Usher type II patients. (2007) Hum Mutat. 28(8):781-9.

Baux D, Blanchet C, Hamel C, Meunier I, Larrieu L, Faugére V, Vaché C, Castorina P, Puech B, Bonneau D, Malcolm S, Claustres M, Roux A F. Enrichment of LOVD-USHbases with 152 USH2A genotypes defines an extensive mutational spectrum and highlights missense hotspots (2014) Hum Mutat. June 18.

SEQUENCE LISTING (52 sequences)

SEQ ID NO: 1 - DNA, 15606 bp, Homo sapiens
atgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgcatcagacaaaaatcagcttctttatcaatggcgtggagaaggatcatacacctttcaatgcaagaactctaagtggttcaattacagattttgcatctggtactgtgcaaataggacagagtttaaatggtttagagcagtttgtcggaagaatgcaagattttcgattataccaagtggcacttacaaacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaattttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggagatgtcagtgccatggtcatgccgataactgcgacacaacaagccagccatatagatgcctctgctcccaggagagcttcactgaaggacttcattgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggaaggaactgtgagctgtgcaaggattactttttccgacaagttggtgcagatccttcggccatagatgtttgcaaaccctgtgactgtgatacagttggcactagaaatggtagcattctttgtgatcagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattgggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaactccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacagctgttgcacactgctaaatcccaagaactatcttacactgtagaaggactgaaaccttataggatatatgagtttactattactctctgcaattcagttggttgtgtgaccagtgcttcgggagcaggacaaactttagcagcagcaccagcacaactgaggccacctctggttaaaggaatcaacagcacaacaatccatcttaggtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggcattaaggccagctttcgaacaaaagtgcctgaaggtttgattgtctttgcagcatcacctggcaatcaggaagagtattttgcacttcagttgaagaagggacgtctttattttctttttgatcctcaggggtcaccagtggaagtaactacaactaatgatcatggcaaacaatatagtgatggaaaatggcatgaaataattgctattaggcatcaggcttttggccaaatcactctggatgggatatatacaggttcctctgccatcctgaatggtagtactgttattggagataacacaggagtctttctgggagggctcccgcgaagttataccatcctcaggaaggatcctgagataatccaaaaaggttttgtgggctgtctcaaggatgtacattttatgaagaattacaatccgtcagctatttgggaacctctggattggcagagttctgaagaacaaatcaacgtgtataacagctgggagggatgtcccgcttcattaaatgagggagctcagttcctaggagcagggttcctggaacttcatccatatatgtttcatggtggaatgaactttgagatttcctttaagttcagaactgaccaattaaatggattgcttcttttcgtttataacaaagatggacctgattttcttgctatggagctgaaaagtggaatattgaccttccggttaaataccagtcttgcctttacacaagtggatctattgctggggctatcctattgtaatggaaagtggaataaagtcattattaaaaaggaaggctctttcatatcagcaagtgtgaatggactgatgaagcatgcatcggagtccggagaccagccactggtggtgaattcaccagtttatgtgggaggaatcccacaggaactgctgaactcttatcaacatttgtgtttggaacaaggtttcggtggttgcatgaaggatgttaaatttacacggggtgctgtcgttaacttggcatctgtgtccagcggtgctgtcagagtcaatctggatggatgcctatcaactgacagtgctgttaactgcaggggaaatgactccatcctggtttaccagggaaaagagcagagtgtttacgagggtggtctccagccttttacagaatacctgtatcgagtgatagcctcgcatgaaggaggttcagtatatagtgattggagtcgaggacgtacaacaggagcagctccacaaagtgtgccaactccctcaagagtccgcagcttaaatggatacagcattgaggtgacctgggatgaacctgttgtcagaggtgtaattgagaagtacattctgaaagcctatagtgaggacagcacccgtccaccccgcatgccctctgccagtgctgaatttgtcaatacaagcaacctcacaggcatattgacaggcttgctacccttcaaaaactatgcagtaaccctaactgcttgcactttggctggctgtactgagagctcacatgcattgaacatctctactccacaagaagccccacaagaggttcagccaccagtagccaaatcccttcccagttctttgctgctctcctggaacccacccaaaaaggcaaatggtattataactcagtactgtttatacatggatgggaggctgatctattcaggcagtgaggagaactacatagtcacagatttagcagtatttacaccccaccagtttctactaagtgcatgcacacatgtgggctgtacaaacagttcctgggtcctactgtacacagcacagctgccaccagaacacgtggattccccagttctgactgtcctggattctagaactatacacatacagtggaaacaaccaagaaaaataagtgggattctggaacgctatgtattatatatgtcaaaccatacacatgattttacaatttggagtgtcatctataacagtacagaacttttccaggatcatatgctacaatacgttttacctggtaataaatatctcatcaagctgggagcttgcacaggtggtgggtgcacagtgagtgaggccagtgaggccctaactgacgaggacatacccgaaggcgtgccagcccccaaagcccactcatattcacctgactcctttaatgtctcctggactgagcctgaatatccgaatggtgttatcacgagttatggattatatctagatggtatattaatccacaattcctcagaactcagctatcgtgcttacggatttgctccttggagtttacattccttcagagtccaagcatgcacggccaaaggttgtgctctgggcccactggtggaaaatcgaactctagaagctcctcctgaaggaacagtaaatgtgtttgtcaaaacacagggatcccggaaagcccacgtgaggtgggaagcaccttttcgccctaatggactcttaacacactcagtccttttcactgggatattctatgtagacccagtaggtaataactacacccttctgaatgtcacaaaagtcatgtacagcggagaagagacaaacctttgggtgctcatcgatgggctggttccttttaccaactatactgtacaagtgaatatttcaaatagccaaggcagcttgataactgatcctataacaattgcaatgcctccaggagctccagatggcgtgctgcctcccaggctttcatctgccactccaaccagtcttcaggttgtctggtctacaccagctcgtaataacgctcctggctctcccagataccaactccagatgaggtctggcgactccacccatggatttctagagttattttccaatccttctgcatcgttaagctatgaagtgagtgatctccaaccgtacacagagtatatgtttcggttggttgcctccaatggatttggcagtgcacatagttcttggattccattcatgaccgcagaggacaaacctggacctgtagttcctccgattcttctggatgtgaagtcaagaatgatgttggtcacctggcagcatcctagaaaatccaatggggttattacccattataacatttatctacatggccgtctatacttgagaactcctggaaatgtcactaattgcacagtgatgcatttacacccatacactgcctataagtttcaggtagaagcctgcacttcaaaaggatgttccctttcaccagagtcccagactgtatggacactcccaggggcaccggaagggatcccaagtccagagctgttctctgatactccaacatctgtgattatatcttggcaaccccctacccaccccaatggcttggtggagaatttcacaattgagagaagagtcaaaggaaaggaagaagttactaccctggtgactctcccgaggagtcattccatgaggtttattgacaagacttctgctcttagcccatggacaaaatatgaatatcgggtactgatgagcactcttcatggaggcacaaacagcagtgcttgggtagaagttaccacaagaccctcacgacctgctggggtgcagccacctgtggtgacagtgctggaacccgatgcagtccaggtcacttggaaacccccactcatccagaacggagacatacttagctatgagattcacatgcctgaccctcacatcactttaaccaatgtgacttccgcagtgttaagtcaaaaagttactcatctgattcctttcactaattattctgtcaccattgttgcttgctcagggggtaatgggtaccttggagggtgcacagagagtttacctacctatgttaccactcaccccaccgtacctcagaatgttggcccattgtctgtgattccactaagtgaatcatatgttgtgatttcttggcaaccaccatccaagccaaatggacctaatttgagatatgagcttctgagacgtaaaatccagcagccacttgcatcaaatcccccagaagatttaaatcggtggcacaatatttattcaggaactcagtggctttatgaagataagggtcttagcaggtttacaacctatgaatatatgctcttcgtacacaacagtgtgggttttacaccgagccgagaagtgactgtgacaacgttagctggtcttccagagagaggagccaatctcactgcgagtgtccttaaccacacagccatcgacgtgaggtgggctaaaccaactgttcaagacctacaaggtgaagttgaatattacacacttttttggagttctgctacctcaaacgactctctaaaaatcttgccagatgtaaactctcatgtcattggccacctaaagccaaacacagagtattggatctttatctctgtcttcaatggagtccacagcatcaacagtgcaggacttcatgcaaccacttgcgatggggagcctcagggcatgcttcctccagaggttgtcatcatcaacagtacagctgtacgtgtcatctggacatctccttcaaacccaaatggtgttgtcactgagtattctatctatgtaaataataagctctacaagactggaatgaatgtgcctgggtcgtttattctgagagacctgtctcccttcactatctatgacattcaggttgaagtctgcacaatatatgcctgcgtgaaaagcaatggaacccaaattaccactgtggaagacactccaagtgatataccaacacccacaattcgtggcatcacttcaagatctcttcaaattgattgggtgtctccacggaagccaaatggcatcattcttggatatgatctcctatggaaaacatggtatccatgcgctaaaactcaaaagttagtgcaggatcagagtgatgagctctgcaaggcagtgaggtgtcaaaaacctgaatctatctgtggacacatttgctattcttctgaagctaaggtttgttgtaacggagtgctctataaccccaagcctggacatcgctgttgtgaagaaaagtatatcccgtttgttctgaattctactggagtttgttgtggtggccgaatacaggaggcacaaccaaatcatcagtgctgctctgggtattacgctagaattctaccaggtgaagtatgctgtccagatgaacagcacaatcgggtttctgttggcattggtgattcctgctgtggcagaatgccgtactccacctcaggaaaccagatttgctgtgctgggaggcttcatgatggccatggccagaagtgctgtggcagacagattgtgagcaacgatttagagtgttgtggtggagaagaaggagtggtgtacaatcgccttccaggtatgttctgttgtgggcaggattatgtgaatatgtcagataccatatgctgctcagcttccagtggagagtctaaagcacatattaaaaagaatgacccggtgccagtaaaatgctgtgagactgaacttattccaaagagccagaaatgctgtaatggagttggatataatcctttgaaatatgtttgctctgacaagatttcaactggaatgatgatgaaggaaaccaaagagtgcaggatcctctgcccagcatctatggaagccacagaacattgtggcaggtgtgacttcaactttaccagccacatttgcactgtgataagagggtctcacaattccacagggaaggcatcaattgaagaaatgtgttcatctgccgaagaaaccattcatacagggagtgtaaacacgtactcttacacagatgtgaacctcaagccctacatgacatatgagtacaggatttctgcctggaacagctatgggcgaggactcagcaaagctgtgagagccagaacaaaagaagatgtgcctcaaggagtgagtccccctacgtggaccaaaatagacaatcttgaagatacaattgtcttaaactggagaaaacctatacaatcaaatggtcctattatttactacatccttcttcgaaatggaattgaacgttttcggggaacatcactgagcttctctgataaagagggaattcaaccatttcaggaatattcatatcagctgaaagcttgcacggttgctggctgtgccaccagtagcaaggtagttgcagctactacccaaggagttccggagagcatcctgccaccaagcatcacagccctaagtgcagtggctctgcatctgagctggagtgtccctgagaaatcaaacggcgtcattaaagagtaccagatcaggcaggttgggaaaggtctcatccacactgacaccactgacaggagacagcatacggtcacaggtctccagccatacaccaactacagcttcactcttacagcttgtacatctgctgggtgcacttcaagcgagccttttctaggtcagacactgcaggcagctcctgaaggagtttgggtgacacctcgacacattatcatcaattctacaacagtggaattatattggagtctgccagaaaagcccaatggcctcgtttctcaatatcaattgagtcgtaatggaaacttgcttttcctgggtggcagtgaggagcagaatttcactgataaaaacctggagcccaatagcagatacacttacaagttagaagtcaaaactggaggtggcagcagtgctagtgatgattacattgttcaaacacctatgtcaacaccagaagaaatctatcctccatataatatcacagtaattgggccttattctatatttgtagcttggataccaccagggatcctcatccccgaaattcctgtggagtacaatgtcttactcaatgatggaagtgtaacacctctggccttctccgttggtcatcatcaatccacccttctggaaaatttgactccattcacacagtatgagataaggatacaagcatgtcaaaatggaagttgtggagttagcagtaggatgtttgtcaaaacacctgaagcagccccaatggatcttaattctcctgttcttaaggcactggggtcagcttgcatagagattaagtggatgccacctgaaaaaccaaatggaatcatcatcaactactttatttacagacgccctgctggcattgaagaggagtctgttttatttgtctggtcagaaggagcccttgaatttatggatgaaggagacaccctgaggcctttcacactctacgaatatcgggtcagagcctgtaactccaagggttcagtggagagtctgtggtcattaacacaaactctggaagctccacctcaagattttccagctccttgggctcaagccacgagtgctcattcagttctgttgaattggacaaagccagaatctcccaatggcattatctcccattaccgtgtggtctaccaggagagacccgacgatcctacatttaacagccctaccgtgcatgctttcacagtgaagggaacaagccatcaagcccacctgtacgggttagaaccattcacaacatatcgcattggtgttgtggctgcaaaccatgcaggagaaattttaagcccttggactctgattcaaaccttagaatcttccccaagtggactgagaaactttatagtagaacagaaagagaatggccgggcattgctactacagtggtcagaacctatgagaaccaatggtgtgattaagacatacaacatcttcagtgacgggttcctggagtactctggtttgaatcgtcagtttctcttccgccgcctggatcctttcactctctacacactgaccctggaggcctgcaccagagcaggttgtgcacactcggcgcctcagcctctgtggacagatgaagcccctccagactctcagctggctcctactgtccactctgtgaagtccaccagtgttgagctgagctggtctgagcctgttaacccaaatggaaaaataattcgctatgaagtgattcgcagatgcttcgagggaaaagcttggggaaatcagacaatccaggccgacgagaaaattgttttcacagaatataacactgaaaggaatacatttatgtataatgacacaggtttgcaaccatggacgcagtgtgaatataaaatctacacttggaattcagctgggcatacctgtagctcttggaatgtggtgaggacattgcaagcacctccagaaggtctctctccacctgtgatatcctatgtttctatgaatccccaaaaactgctgatttcctggatcccaccagaacagtctaatggtattatccagtcctataggcttcaaaggaatgaaatgctctatccttttagctttgatcctgtgactttcaattacactgatgaagagcttcttcctttttccacctatagctatgcactccaagcctgcacgagtggaggatgctccaccagcaaacccaccagcatcacaactctggaggctgctccatcagaagtcagccctccagatctttgggccgtcagtgccactcaaatgaatgtatgttggtcaccgcccacagtgcaaaatggaaagattactaaatatttagttagatatgataataaagagtcccttgctggccagggcctgtgcctgctggtttcccacctgcagccttactctcagtataacttctcccttgtagcctgcacgaatggaggttgcacagctagtgtgtcaaaatctgcctggacaatggaggccctgccagagaacatggactctccaacattgcaagtcacaggctcagaatcaatagaaatcacctggaaacctccaagaaacccaaatggccagatcagaagttatgaacttaggagggatggaaccattgtatatacaggcttggaaacacgctatcgtgattttactctcaccccaggtgtggagtatagctacacagtaactgccagcaacagccaagggggtattttgagtcctcttgtcaaagatcgaaccagcccctcagcaccctcagggatggaacctccaaaattgcaggccaggggtcctcaggagatcttagtgaactgggaccctccagtgagaacaaatggtgatatcatcaattataccctcttcatccgtgaactatttgaaagagaaactaaaatcatacacataaacacaactcataattcttttggtatgcagtcatatatagtaaaccagctgaagccatttcacaggtatgaaatacgaattcaagcgtgcaccaccctgggatgtgcatcaagtgactggacattcatacagacccctgagattgcacctttgatgcaaccccctccacatctggaggtacaaatggctccaggaggattccagccaactgtttctcttttgtggacaggaccgctgcagccaaatggaaaagttttgtattacgaattatacagaagacaaatagcaactcagcctagaaaatccaatccagtcctaatctataacggaagctcaacatcttttatagattccgaactattgcctttcacagagtatgagtatcaggtctgggcagtgaattctgcaggaaaagcccccagtagctggacatggtgcagaaccgggccagccccaccagaaggtctcagagcccccacgttccatgtgatctcttctacccaagcagtggtcaacatcagtgcccctgggaagcccaacgggatcgtcagtctctacaggctgttctccagcagcgcccatggggctgagacagtgctatccgaaggcatggccacccagcagactctccatggccttcaagccttcactaactactctattggagtagaggcctgcacctgcttcaactgttgcagcaaaggaccgacagctgaactgagaacccatcctgccccaccctcaggactgtcctctccacaaatcgggacgctggcctcaaggacggcctccttccggtggagtccccccatgttccccaatggtgtcattcacagctatgaactccaattccacgtggcttgccctcctgactcagccctcccctgtactcccagccaaatagaaacaaagtacacggggctggggcagaaagccagccttgggggtctccagccctacaccacatacaagctgagagtggtggcacacaacgaggtgggcagtacggcttccgagtggatcagtttcaccacccaaaaagaattgcctcagtaccgagccccattttcggtggacagcaatttgtctgtggtgtgtgtgaactggagtgacaccttcctcctgaacggccaactgaaggagtacgtgttaaccgacggagggcgacgcgtgtacagcggcttggacaccaccctctacataccgagaacggcggacaaaaccttctttttccaggtcatctgcacgactgacgaaggaagtgttaagacgccgttgatccaatatgatacctctactggacttggcttggtcctaacaactcctgggaaaaagaagggatcgcggagcaaaagcacagagttctacagcgagctgtggttcatagtgttaatggcgatgctgggcttgatcttgttggccatttttctgtccctgatactacaaagaaaaatccacaaagagccatatatcagagaaagacctcccttggtacctcttcagaagaggatgtctccattgaatgtttacccaccgggggaaaaccatatggggttagccgataccaaaattccccggtctgggacacctgtgagtatccgcagcaaccggagtgcatgtgtcctgcgcatcccgagtcaaaaccaaaccagcctaacctactcccagggttctcttcaccgcagcgtcagccagctcatggacattcaagacaagaaagtcttgatggacaactcactgtgggaagccatcatgggccacaacagtggactgtatgtggatgaagaggacctgatgaacgccatcaaggatttcagctcagtgactaaggaacgcaccacattcacagacacccacctg

SEQ ID NO: 2 - DNA, 15758 bp, Homo sapiens
atgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgcatcagacaaaaatcagcttctttatcaatggcgtggagaaggatcatacacctttcaatgcaagaactctaagtggttcaattacagattttgcatctggtactgtgcaaataggacagagtttaaatggtttagagcagtttgtcggaagaatgcaagattttcgattataccaagtggcacttacaaacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaattttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggagatgtcagtgccatggtcatgccgataactgcgacacaacaagccagccatatagatgcctctgctcccaggagagcttcactgaaggacttcattgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggaaggaactgtgagctgtgcaaggattactttttccgacaagttggtgcagatccttcggccatagatgtttgcaaaccctgtgactgtgatacagttggcactagaaatggtagcattctttgtgatcagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattgggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaactccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacagctgttgcacactgctaaatcccaagaactatcttacactgtagaaggactgaaaccttataggatatatgagtttactattactctctgcaattcagttggttgtgtgaccagtgcttcgggagcaggacaaactttagcagcagcaccagcacaactgaggccacctctggttaaaggaatcaacagcacaacaatccatcttaggtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggcattaaggccagctttcgaacaaaagtgcctgaaggtttgattgtctttgcagcatcacctggcaatcaggaagagtattttgcacttcagttgaagaagggacgtctttattttctttttgatcctcaggggtcaccagtggaagtaactacaactaatgatcatggcaaacaatatagtgatggaaaatggcatgaaataattgctattaggcatcaggcttttggccaaatcactctggatgggatatatacaggttcctctgccatcctgaatggtagtactgttattggagataacacaggagtctttctgggagggctcccgcgaagttataccatcctcaggaaggatcctgagataatccaaaaaggttttgtgggctgtctcaaggatgtacattttatgaagaattacaatccgtcagctatttgggaacctctggattggcagagttctgaagaacaaatcaacgtgtataacagctgggagggatgtcccgcttcattaaatgagggagctcagttcctaggagcagggttcctggaacttcatccatatatgtttcatggtggaatgaactttgagatttcctttaagttcagaactgaccaattaaatggattgcttcttttcgtttataacaaagatggacctgattttcttgctatggagctgaaaagtggaatattgaccttccggttaaataccagtcttgcctttacacaagtggatctattgctggggctatcctattgtaatggaaagtggaataaagtcattattaaaaaggaaggctctttcatatcagcaagtgtgaatggactgatgaagcatgcatcggagtccggagaccagccactggtggtgaattcaccagtttatgtgggaggaatcccacaggaactgctgaactcttatcaacatttgtgtttggaacaaggtttcggtggttgcatgaaggatgttaaatttacacggggtgctgtcgttaacttggcatctgtgtccagcggtgctgtcagagtcaatctggatggatgcctatcaactgacagtgctgttaactgcaggggaaatgactccatcctggtttaccagggaaaagagcagagtgtttacgagggtggtctccagccttttacagaatacctgtatcgagtgatagcctcgcatgaaggaggttcagtatatagtgattggagtcgaggacgtacaacaggagcagctccacaaagtgtgccaactccctcaagagtccgcagcttaaatggatacagcattgaggtgacctgggatgaacctgttgtcagaggtgtaattgagaagtacattctgaaagcctatagtgaggacagcacccgtccaccccgcatgccctctgccagtgctgaatttgtcaatacaagcaacctcacaggcatattgacaggcttgctacccttcaaaaactatgcagtaaccctaactgcttgcactttggctggctgtactgagagctcacatgcattgaacatctctactccacaagaagccccacaagaggttcagccaccagtagccaaatcccttcccagttctttgctgctctcctggaacccacccaaaaaggcaaatggtattataactcagtactgtttatacatggatgggaggctgatctattcaggcagtgaggagaactacatagtcacagatttagcagtatttacaccccaccagtttctactaagtgcatgcacacatgtgggctgtacaaacagttcctgggtcctactgtacacagcacagctgccaccagaacacgtggattccccagttctgactgtcctggattctagaactatacacatacagtggaaacaaccaagaaaaataagtgggattctggaacgctatgtattatatatgtcaaaccatacacatgattttacaatttggagtgtcatctataacagtacagaacttttccaggatcatatgctacaatacgttttacctggtaataaatatctcatcaagctgggagcttgcacaggtggtgggtgcacagtgagtgaggccagtgaggccctaactgacgaggacatacccgaaggcgtgccagcccccaaagcccactcatattcacctgactcctttaatgtctcctggactgagcctgaatatccgaatggtgttatcacgagttatggattatatctagatggtatattaatccacaattcctcagaactcagctatcgtgcttacggatttgctccttggagtttacattccttcagagtccaagcatgcacggccaaaggttgtgctctgggcccactggtggaaaatcgaactctagaagctcctcctgaaggaacagtaaatgtgtttgtcaaaacacagggatcccggaaagcccacgtgaggtgggaagcaccttttcgccctaatggactcttaacacactcagtccttttcactgggatattctatgtagacccagtaggtaataactacacccttctgaatgtcacaaaagtcatgtacagcggagaagagacaaacctttgggtgctcatcgatgggctggttccttttaccaactatactgtacaagtgaatatttcaaatagccaaggcagcttgataactgatcctataacaattgcaatgcctccaggagctccagatggcgtgctgcctcccaggctttcatctgccactccaaccagtcttcaggttgtctggtctacaccagctcgtaataacgctcctggctctcccagataccaactccagatgaggtctggcgactccacccatggatttctagagttattttccaatccttctgcatcgttaagctatgaagtgagtgatctccaaccgtacacagagtatatgtttcggttggttgcctccaatggatttggcagtgcacatagttcttggattccattcatgaccgcagaggacacttcctctccagaatcacacaagttaaaggacccttctgcaacaagagcagcgaatctactcagccagagcaggaagctaataaaatgtatgctggcttttaagggggaaacaaatcatgaaattgaaattgaacacctctcctttcccaagaacctggacctgtagttcctccgattcttctggatgtgaagtcaagaatgatgttggtcacctggcagcatcctagaaaatccaatggggttattacccattataacatttatctacatggccgtctatacttgagaactcctggaaatgtcactaattgcacagtgatgcatttacacccatacactgcctataagtttcaggtagaagcctgcacttcaaaaggatgttccctttcaccagagtcccagactgtatggacactcccaggggcaccggaagggatcccaagtccagagctgttctctgatactccaacatctgtgattatatcttggcaaccccctacccaccccaatggcttggtggagaatttcacaattgagagaagagtcaaaggaaaggaagaagttactaccctggtgactctcccgaggagtcattccatgaggtttattgacaagacttctgctcttagcccatggacaaaatatgaatatcgggtactgatgagcactcttcatggaggcacaaacagcagtgcttgggtagaagttaccacaagaccctcacgacctgctggggtgcagccacctgtggtgacagtgctggaacccgatgcagtccaggtcacttggaaacccccactcatccagaacggagacatacttagctatgagattcacatgcctgaccctcacatcactttaaccaatgtgacttccgcagtgttaagtcaaaaagttactcatctgattcctttcactaattattctgtcaccattgttgcttgctcagggggtaatgggtaccttggagggtgcacagagagtttacctacctatgttaccactcaccccaccgtacctcagaatgttggcccattgtctgtgattccactaagtgaatcatatgttgtgatttcttggcaaccaccatccaagccaaatggacctaatttgagatatgagcttctgagacgtaaaatccagcagccacttgcatcaaatcccccagaagatttaaatcggtggcacaatatttattcaggaactcagtggctttatgaagataagggtcttagcaggtttacaacctatgaatatatgctcttcgtacacaacagtgtgggttttacaccgagccgagaagtgactgtgacaacgttagctggtcttccagagagaggagccaatctcactgcgagtgtccttaaccacacagccatcgacgtgaggtgggctaaaccaactgttcaagacctacaaggtgaagttgaatattacacacttttttggagttctgctacctcaaacgactctctaaaaatcttgccagatgtaaactctcatgtcattggccacctaaagccaaacacagagtattggatctttatctctgtcttcaatggagtccacagcatcaacagtgcaggacttcatgcaaccacttgcgatggggagcctcagggcatgcttcctccagaggttgtcatcatcaacagtacagctgtacgtgtcatctggacatctccttcaaacccaaatggtgttgtcactgagtattctatctatgtaaataataagctctacaagactggaatgaatgtgcctgggtcgtttattctgagagacctgtctcccttcactatctatgacattcaggttgaagtctgcacaatatatgcctgcgtgaaaagcaatggaacccaaattaccactgtggaagacactccaagtgatataccaacacccacaattcgtggcatcacttcaagatctcttcaaattgattgggtgtctccacggaagccaaatggcatcattcttggatatgatctcctatggaaaacatggtatccatgcgctaaaactcaaaagttagtgcaggatcagagtgatgagctctgcaaggcagtgaggtgtcaaaaacctgaatctatctgtggacacatttgctattcttctgaagctaaggtttgttgtaacggagtgctctataaccccaagcctggacatcgctgttgtgaagaaaagtatatcccgtttgttctgaattctactggagtttgttgtggtggccgaatacaggaggcacaaccaaatcatcagtgctgctctgggtattacgctagaattctaccaggtgaagtatgctgtccagatgaacagcacaatcgggtttctgttggcattggtgattcctgctgtggcagaatgccgtactccacctcaggaaaccagatttgctgtgctgggaggcttcatgatggccatggccagaagtgctgtggcagacagattgtgagcaacgatttagagtgttgtggtggagaagaaggagtggtgtacaatcgccttccaggtatgttctgttgtgggcaggattatgtgaatatgtcagataccatatgctgctcagcttccagtggagagtctaaagcacatattaaaaagaatgacccggtgccagtaaaatgctgtgagactgaacttattccaaagagccagaaatgctgtaatggagttggatataatcctttgaaatatgtttgctctgacaagatttcaactggaatgatgatgaaggaaaccaaagagtgcaggatcctctgcccagcatctatggaagccacagaacattgtggcaggtgtgacttcaactttaccagccacatttgcactgtgataagagggtctcacaattccacagggaaggcatcaattgaagaaatgtgttcatctgccgaagaaaccattcatacagggagtgtaaacacgtactcttacacagatgtgaacctcaagccctacatgacatatgagtacaggatttctgcctggaacagctatgggcgaggactcagcaaagctgtgagagccagaacaaaagaagatgtgcctcaaggagtgagtccccctacgtggaccaaaatagacaatcttgaagatacaattgtcttaaactggagaaaacctatacaatcaaatggtcctattatttactacatccttcttcgaaatggaattgaacgttttcggggaacatcactgagcttctctgataaagagggaattcaaccatttcaggaatattcatatcagctgaaagcttgcacggttgctggctgtgccaccagtagcaaggtagttgcagctactacccaaggagttccggagagcatcctgccaccaagcatcacagccctaagtgcagtggctctgcatctgagctggagtgtccctgagaaatcaaacggcgtcattaaagagtaccagatcaggcaggttgggaaaggtctcatccacactgacaccactgacaggagacagcatacggtcacaggtctccagccatacaccaactacagcttcactcttacagcttgtacatctgctgggtgcacttcaagcgagccttttctaggtcagacactgcaggcagctcctgaaggagtttgggtgacacctcgacacattatcatcaattctacaacagtggaattatattggagtctgccagaaaagcccaatggcctcgtttctcaatatcaattgagtcgtaatggaaacttgcttttcctgggtggcagtgaggagcagaatttcactgataaaaacctggagcccaatagcagatacacttacaagttagaagtcaaaactggaggtggcagcagtgctagtgatgattacattgttcaaacacctatgtcaacaccagaagaaatctatcctccatataatatcacagtaattgggccttattctatatttgtagcttggataccaccagggatcctcatccccgaaattcctgtggagtacaatgtcttactcaatgatggaagtgtaacacctctggccttctccgttggtcatcatcaatccacccttctggaaaatttgactccattcacacagtatgagataaggatacaagcatgtcaaaatggaagttgtggagttagcagtaggatgtttgtcaaaacacctgaagcagccccaatggatcttaattctcctgttcttaaggcactggggtcagcttgcatagagattaagtggatgccacctgaaaaaccaaatggaatcatcatcaactactttatttacagacgccctgctggcattgaagaggagtctgttttatttgtctggtcagaaggagcccttgaatttatggatgaaggagacaccctgaggcctttcacactctacgaatatcgggtcagagcctgtaactccaagggttcagtggagagtctgtggtcattaacacaaactctggaagctccacctcaagattttccagctccttgggctcaagccacgagtgctcattcagttctgttgaattggacaaagccagaatctcccaatggcattatctcccattaccgtgtggtctaccaggagagacccgacgatcctacatttaacagccctaccgtgcatgctttcacagtgaagggaacaagccatcaagcccacctgtacgggttagaaccattcacaacatatcgcattggtgttgtggctgcaaaccatgcaggagaaattttaagcccttggactctgattcaaaccttagaatcttccccaagtggactgagaaactttatagtagaacagaaagagaatggccgggcattgctactacagtggtcagaacctatgagaaccaatggtgtgattaagacatacaacatcttcagtgacgggttcctggagtactctggtttgaatcgtcagtttctcttccgccgcctggatcctttcactctctacacactgaccctggaggcctgcaccagagcaggttgtgcacactcggcgcctcagcctctgtggacagatgaagcccctccagactctcagctggctcctactgtccactctgtgaagtccaccagtgttgagctgagctggtctgagcctgttaacccaaatggaaaaataattcgctatgaagtgattcgcagatgcttcgagggaaaagcttggggaaatcagacaatccaggccgacgagaaaattgttttcacagaatataacactgaaaggaatacatttatgtataatgacacaggtttgcaaccatggacgcagtgtgaatataaaatctacacttggaattcagctgggcatacctgtagctcttggaatgtggtgaggacattgcaagcacctccagaaggtctctctccacctgtgatatcctatgtttctatgaatccccaaaaactgctgatttcctggatcccaccagaacagtctaatggtattatccagtcctataggcttcaaaggaatgaaatgctctatccttttagctttgatcctgtgactttcaattacactgatgaagagcttcttcctttttccacctatagctatgcactccaagcctgcacgagtggaggatgctccaccagcaaacccaccagcatcacaactctggaggctgctccatcagaagtcagccctccagatctttgggccgtcagtgccactcaaatgaatgtatgttggtcaccgcccacagtgcaaaatggaaagattactaaatatttagttagatatgataataaagagtcccttgctggccagggcctgtgcctgctggtttcccacctgcagccttactctcagtataacttctcccttgtagcctgcacgaatggaggttgcacagctagtgtgtcaaaatctgcctggacaatggaggccctgccagagaacatggactctccaacattgcaagtcacaggctcagaatcaatagaaatcacctggaaacctccaagaaacccaaatggccagatcagaagttatgaacttaggagggatggaaccattgtatatacaggcttggaaacacgctatcgtgattttactctcaccccaggtgtggagtatagctacacagtaactgccagcaacagccaagggggtattttgagtcctcttgtcaaagatcgaaccagcccctcagcaccctcagggatggaacctccaaaattgcaggccaggggtcctcaggagatcttagtgaactgggaccctccagtgagaacaaatggtgatatcatcaattataccctcttcatccgtgaactatttgaaagagaaactaaaatcatacacataaacacaactcataattcttttggtatgcagtcatatatagtaaaccagctgaagccatttcacaggtatgaaatacgaattcaagcgtgcaccaccctgggatgtgcatcaagtgactggacattcatacagacccctgagattgcacctttgatgcaaccccctccacatctggaggtacaaatggctccaggaggattccagccaactgtttctcttttgtggacaggaccgctgcagccaaatggaaaagttttgtattacgaattatacagaagacaaatagcaactcagcctagaaaatccaatccagtcctaatctataacggaagctcaacatcttttatagattccgaactattgcctttcacagagtatgagtatcaggtctgggcagtgaattctgcaggaaaagcccccagtagctggacatggtgcagaaccgggccagccccaccagaaggtctcagagcccccacgttccatgtgatctcttctacccaagcagtggtcaacatcagtgcccctgggaagcccaacgggatcgtcagtctctacaggctgttctccagcagcgcccatggggctgagacagtgctatccgaaggcatggccacccagcagactctccatggccttcaagccttcactaactactctattggagtagaggcctgcacctgcttcaactgttgcagcaaaggaccgacagctgaactgagaacccatcctgccccaccctcaggactgtcctctccacaaatcgggacgctggcctcaaggacggcctccttccggtggagtccccccatgttccccaatggtgtcattcacagctatgaactccaattccacgtggcttgccctcctgactcagccctcccctgtactcccagccaaatagaaacaaagtacacggggctggggcagaaagccagccttgggggtctccagccctacaccacatacaagctgagagtggtggcacacaacgaggtgggcagtacggcttccgagtggatcagtttcaccacccaaaaagaattgcctcagtaccgagccccattttcggtggacagcaatttgtctgtggtgtgtgtgaactggagtgacaccttcctcctgaacggccaactgaaggagtacgtgttaaccgacggagggcgacgcgtgtacagcggcttggacaccaccctctacataccgagaacggcggacaaaaccttctttttccaggtcatctgcacgactgacgaaggaagtgttaagacgccgttgatccaatatgatacctctactggacttggcttggtcctaacaactcctgggaaaaagaagggatcgcggagcaaaagcacagagttctacagcgagctgtggttcatagtgttaatggcgatgctgggcttgatcttgttggccatttttctgtccctgatactacaaagaaaaatccacaaagagccatatatcagagaaagacctcccttggtacctcttcagaagaggatgtctccattgaatgtttacccaccgggggaaaaccatatggggttagccgataccaaaattccccggtctgggacacctgtgagtatccgcagcaaccggagtgcatgtgtcctgcgcatcccgagtcaaaaccaaaccagcctaacctactcccagggttctcttcaccgcagcgtcagccagctcatggacattcaagacaagaaagtcttgatggacaactcactgtgggaagccatcatgggccacaacagtggactgtatgtggatgaagaggacctgatgaacgccatcaaggatttcagctcagtgactaaggaacgcaccacattcacagacacccacctg

SEQ ID NO: 3 - protein, 5202 aa, Homo sapiens
MNCPVLSLGSGFLFQVIEMLIFAYFASISLTESRGLFPRLENVGAFKKVSIVPTQAVCGLPDRSTFCHSSAAAESIQFCTQRFCIQDCPYRSSHPTYTALFSAGLSSCITPDKNDLHPNAHSNSASFIFGNHKSCFSSPPSPKLMASFTLAVWLKPEQQGVMCVIEKTVDGQIVFKLTISEKETMFYYRTVNGLQPPIKVMTLGRILVKKWIHLSVQVHQTKISFFINGVEKDHTPFNARTLSGSITDFASGTVQIGQSLNGLEQFVGRMQDFRLYQVALTNREILEVFSGDLLRLHAQSHCRCPGSHPRVHPLAQRYCIPNDAGDTADNRVSRLNPEAHPLSFVNDNDVGTSWVSNVFTNITQLNQGVTISVDLENGQYQVFYIIIQFFSPQPTEIRIQRKKENSLDWEDWQYFARNCGAFGMKNNGDLEKPDSVNCLQLSNFTPYSRGNVTFSILTPGPNYRPGYNNFYNTPSLQEFVKATQIRFHFHGQYYTTETAVNLRHRYYAVDEITISGRCQCHGHADNCDTTSQPYRCLCSQESFTEGLHCDRCLPLYNDKPFRQGDQVYAFNCKPCQCNSHSKSCHYNISVDPFPFEHFRGGGGVCDDCEHNTTGRNCELCKDYFFRQVGADPSAIDVCKPCDCDTVGTRNGSILCDQIGGQCNCKRHVSGRQCNQCQNGFYNLQELDPDGCSPCNCNTSGTVDGDITCHQNSGQCKCKANVIGLRCDHCNFGFKFLRSFNDVGCEPCQCNLHGSVNKFCNPHSGQCECKKEAKGLQCDTCRENFYGLDVTNCKACDCDTAGSLPGTVCNAKTGQCICKPNVEGRQCNKCLEGNFYLRQNNSFLCLPCNCDKTGTINGSLLCNKSTGQCPCKLGVTGLRCNQCEPHRYNLTIDNFQHCQMCECDSLGTLPGTICDPISGQCLCVPNRQGRRCNQCQPGFYISPGNATGCLPCSCHTTGAVNHICNSLTGQCVCQDASIAGQRCDQCKDHYFGFDPQTGRCQPCNCHLSGALNETCHLVTGQCFCKQFVTGSKCDACVPSASHLDVNNLLGCSKTPFQQPPPRGQVQSSSAINLSWSPPDSPNAHWLTYSLLRDGFEIYTTEDQYPYSIQYFLDTDLLPYTKYSYYIETTNVHGSTRSVAVTYKTKPGVPEGNLTLSYIIPIGSDSVTLTWTTLSNQSGPIEKYILSCAPLAGGQPCVSYEGHETSATIWNLVPFAKYDFSVQACTSGGCLHSLPITVTTAQAPPQRLSPPKMQKISSTELHVEWSPPAELNGIIIRYELYMRRLRSTKETTSEESRVFQSSGWLSPHSFVESANENALKPPQTMTTITGLEPYTKYEFRVLAVNMAGSVSSAWVSERTGESAPVFMIPPSVFPLSSYSLNISWEKPADNVTRGKVVGYDINMLSEQSPQQSIPMAFSQLLHTAKSQELSYTVEGLKPYRIYEFTITLCNSVGCVTSASGAGQTLAAAPAQLRPPLVKGINSTTIHLRWFPPEELNGPSPIYQLERRESSLPALMTTMMKGIRFIGNGYCKFPSSTHPVNTDFTGIKASFRTKVPEGLIVFAASPGNQEEYFALQLKKGRLYFLFDPQGSPVEVTTTNDHGKQYSDGKWHEIIAIRHQAFGQITLDGIYTGSSAILNGSTVIGDNTGVFLGGLPRSYTILRKDPEIIQKGFVGCLKDVHFMKNYNPSAIWEPLDWQSSEEQINVYNSWEGCPASLNEGAQFLGAGFLELHPYMFHGGMNFEISFKFRTDQLNGLLLFVYNKDGPDFLAMELKSGILTFRLNTSLAFTQVDLLLGLSYCNGKWNKVIIKKEGSFISASVNGLMKHASESGDQPLVVNSPVYVGGIPQELLNSYQHLCLEQGFGGCMKDVKFTRGAVVNLASVSSGAVRVNLDGCLSTDSAVNCRGNDSILVYQGKEQSVYEGGLQPFTEYLYRVIASHEGGSVYSDWSRGRTTGAAPQSVPTPSRVRSLNGYSIEVTWDEPVVRGVIEKYILKAYSEDSTRPPRMPSASAEFVNTSNLTGILTGLLPFKNYAVTLTACTLAGCTESSHALNISTPQEAPQEVQPPVAKSLPSSLLLSWNPPKKANGIITQYCLYMDGRLIYSGSEENYIVTDLAVFTPHQFLLSACTHVGCTNSSWVLLYTAQLPPEHVDSPVLTVLDSRTIHIQWKQPRKISGILERYVLYMSNHTHDFTIWSVIYNSTELFQDHMLQYVLPGNKYLIKLGACTGGGCTVSEASEALTDEDIPEGVPAPKAHSYSPDSFNVSWTEPEYPNGVITSYGLYLDGILIHNSSELSYRAYGFAPWSLHSFRVQACTAKGCALGPLVENRTLEAPPEGTVNVFVKTQGSRKAHVRWEAPFRPNGLLTHSVLFTGIFYVDPVGNNYTLLNVTKVMYSGEETNLWVLIDGLVPFTNYTVQVNISNSQGSLITDPITIAMPPGAPDGVLPPRLSSATPTSLQVVWSTPARNNAPGSPRYQLQMRSGDSTHGFLELFSNPSASLSYEVSDLQPYTEYMFRLVASNGFGSAHSSWIPFMTAEDKPGPVVPPILLDVKSRMMLVTWQHPRKSNGVITHYNIYLHGRLYLRTPGNVTNCTVMHLHPYTAYKFQVEACTSKGCSLSPESQTVWTLPGAPEGIPSPELFSDTPTSVIISWQPPTHPNGLVENFTIERRVKGKEEVTTLVTLPRSHSMRFIDKTSALSPWTKYEYRVLMSTLHGGTNSSAWVEVTTRPSRPAGVQPPVVTVLEPDAVQVTWKPPLIQNGDILSYEIHMPDPHITLTNVTSAVLSQKVTHLIPFTNYSVTIVACSGGNGYLGGCTESLPTYVTTHPTVPQNVGPLSVIPLSESYVVISWQPPSKPNGPNLRYELLRRKIQQPLASNPPEDLNRWHNIYSGTQWLYEDKGLSRFTTYEYMLFVHNSVGFTPSREVTVTTLAGLPERGANLTASVLNHTAIDVRWAKPTVQDLQGEVEYYTLFWSSATSNDSLKILPDVNSHVIGHLKPNTEYWIFISVFNGVHSINSAGLHATTCDGEPQGMLPPEVVIINSTAVRVIWTSPSNPNGVVTEYSIYVNNKLYKTGMNVPGSFILRDLSPFTIYDIQVEVCTIYACVKSNGTQITTVEDTPSDIPTPTIRGITSRSLQIDWVSPRKPNGIILGYDLLWKTWYPCAKTQKLVQDQSDELCKAVRCQKPESICGHICYSSEAKVCCNGVLYNPKPGHRCCEEKYIPFVLNSTGVCCGGRIQEAQPNHQCCSGYYARILPGEVCCPDEQHNRVSVGIGDSCCGRMPYSTSGNQICCAGRLHDGHGQKCCGRQIVSNDLECCGGEEGVVYNRLPGMFCCGQDYVNMSDTICCSASSGESKAHIKKNDPVPVKCCETELIPKSQKCCNGVGYNPLKYVCSDKISTGMMMKETKECRILCPASMEATEHCGRCDFNFTSHICTVIRGSHNSTGKASIEEMCSSAEETIHTGSVNTYSYTDVNLKPYMTYEYRISAWNSYGRGLSKAVRARTKEDVPQGVSPPTWTKIDNLEDTIVLNWRKPIQSNGPIIYYILLRNGIERFRGTSLSFSDKEGIQPFQEYSYQLKACTVAGCATSSKVVAATTQGVPESILPPSITALSAVALHLSWSVPEKSNGVIKEYQIRQVGKGLIHTDTTDRRQHTVTGLQPYTNYSFTLTACTSAGCTSSEPFLGQTLQAAPEGVWVTPRHIIINSTTVELYWSLPEKPNGLVSQYQLSRNGNLLFLGGSEEQNFTDKNLEPNSRYTYKLEVKTGGGSSASDDYIVQTPMSTPEEIYPPYNITVIGPYSIFVAWIPPGILIPEIPVEYNVLLNDGSVTPLAFSVGHHQSTLLENLTPFTQYEIRIQACQNGSCGVSSRMFVKTPEAAPMDLNSPVLKALGSACIEIKWMPPEKPNGIIINYFIYRRPAGIEEESVLFVWSEGALEFMDEGDTLRPFTLYEYRVRACNSKGSVESLWSLTQTLEAPPQDFPAPWAQATSAHSVLLNWTKPESPNGIISHYRVVYQERPDDPTFNSPTVHAFTVKGTSHQAHLYGLEPFTTYRIGVVAANHAGEILSPWTLIQTLESSPSGLRNFIVEQKENGRALLLQWSEPMRTNGVIKTYNIFSDGFLEYSGLNRQFLFRRLDPFTLYTLTLEACTRAGCAHSAPQPLWTDEAPPDSQLAPTVHSVKSTSVELSWSEPVNPNGKIIRYEVIRRCFEGKAWGNQTIQADEKIVFTEYNTERNTFMYNDTGLQPWTQCEYKIYTWNSAGHTCSSWNVVRTLQAPPEGLSPPVISYVSMNPQKLLISWIPPEQSNGIIQSYRLQRNEMLYPFSFDPVTFNYTDEELLPFSTYSYALQACTSGGCSTSKPTSITTLEAAPSEVSPPDLWAVSATQMNVCWSPPTVQNGKITKYLVRYDNKESLAGQGLCLLVSHLQPYSQYNFSLVACTNGGCTASVSKSAWTMEALPENMDSPTLQVTGSESIEITWKPPRNPNGQIRSYELRRDGTIVYTGLETRYRDFTLTPGVEYSYTVTASNSQGGILSPLVKDRTSPSAPSGMEPPKLQARGPQEILVNWDPPVRTNGDIINYTLFIRELFERETKIIHINTTHNSFGMQSYIVNQLKPFHRYEIRIQACTTLGCASSDWTFIQTPEIAPLMQPPPHLEVQMAPGGFQPTVSLLWTGPLQPNGKVLYYELYRRQIATQPRKSNPVLIYNGSSTSFIDSELLPFTEYEYQVWAVNSAGKAPSSWTWCRTGPAPPEGLRAPTFHVISSTQAVVNISAPGKPNGIVSLYRLFSSSAHGAETVLSEGMATQQTLHGLQAFTNYSIGVEACTCFNCCSKGPTAELRTHPAPPSGLSSPQIGTLASRTASFRWSPPMFPNGVIHSYELQFHVACPPDSALPCTPSQIETKYTGLGQKASLGGLQPYTTYKLRVVAHNEVGSTASEWISFTTQKELPQYRAPFSVDSNLSVVCVNWSDTFLLNGQLKEYVLTDGGRRVYSGLDTTLYIPRTADKTFFFQVICTTDEGSVKTPLIQYDTSTGLGLVLTTPGKKKGSRSKSTEFYSELWFIVLMAMLGLILLAIFLSLILQRKIHKEPYIRERPPLVPLQKRMSPLNVYPPGENHMGLADTKIPRSGTPVSIRSNRSACVLRIPSQNQTSLTYSQGSLHRSVSQLMDIQDKKVLMDNSLWEAIMGHNSGLYVDEEDLMNAIKDFSSVTKERTTFTDTHL

SEQ ID NO: 4 - protein, 2586 aa, Homo sapiens
MNCPVLSLGSGFLFQVIEMLIFAYFASISLTESRGLFPRLENVGAFKKVSIVPTQAVCGLPDRSTFCHSSAAAESIQFCTQRFCIQDCPYRSSHPTYTALFSAGLSSCITPDKNDLHPNAHSNSASFIFGNHKSCFSSPPSPKLMASFTLAVWLKPEQQGVMCVIEKTVDGQIVFKLTISEKETMFYYRTVNGLQPPIKVMTLGRILVKKWIHLSVQVHQTKISFFINGVEKDHTPFNARTLSGSITDFASGTVQIGQSLNGLEQFVGRMQDFRLYQVALTNREILEVFSGDLLRLHAQSHCRCPGSHPRVHPLAQRYCIPNDAGDTADNRVSRLNPEAHPLSFVNDNDVGTSWVSNVFTNITQLNQGVTISVDLENGQYQVFYIIIQFFSPQPTEIRIQRKKENSLDWEDWQYFARNCGAFGMKNNGDLEKPDSVNCLQLSNFTPYSRGNVTFSILTPGPNYRPGYNNFYNTPSLQEFVKATQIRFHFHGQYYTTETAVNLRHRYYAVDEITISGRCQCHGHADNCDTTSQPYRCLCSQESFTEGLHCDRCLPLYNDKPFRQGDQVYAFNCKPCQCNSHSKSCHYNISVDPFPFEHFRGGGGVCDDCEHNTTGRNCELCKDYFFRQVGADPSAIDVCKPCDCDTVGTRNGSILCDQIGGQCNCKRHVSGRQCNQCQNGFYNLQELDPDGCSPCNCNTSGTVDGDITCHQNSGQCKCKANVIGLRCDHCNFGFKFLRSFNDVGCEPCQCNLHGSVNKFCNPHSGQCECKKEAKGLQCDTCRENFYGLDVTNCKACDCDTAGSLPGTVCNAKTGQCICKPNVEGRQCNKCLEGNFYLRQNNSFLCLPCNCDKTGTINGSLLCNKSTGQCPCKLGVTGLRCNQCEPHRYNLTIDNFQHCQMCECDSLGTLPGTICDPISGQCLCVPNRQGRRCNQCQPGFYISPGNATGCLPCSCHTTGAVNHICNSLTGQCVCQDASIAGQRCDQCKDHYFGFDPQTGRCQPCNCHLSGALNETCHLVTGQCFCKQFVTGSKCDACVPSASHLDVNNLLGCSKTPFQQPPPRGQVQSSSAINLSWSPPDSPNAHWLTYSLLRDGFEIYTTEDQYPYSIQYFLDTDLLPYTKYSYYIETTNVHGSTRSVAVTYKTKPGVPEGNLTLSYIIPIGSDSVTLTWTTLSNQSGPIEKYILSCAPLAGGQPCVSYEGHETSATIWNLVPFAKYDFSVQACTSGGCLHSLPITVTTAQAPPQRLSPPKMQKISSTELHVEWSPPAELNGIIIRYELYMRRLRSTKETTSEESRVFQSSGWLSPHSFVESANENALKPPQTMTTITGLEPYTKYEFRVLAVNMAGSVSSAWVSERTGESAPVFMIPPSVFPLSSYSLNISWEKPADNVTRGKVVGYDINMLSEQSPQQSIPMAFSQLLHTAKSQELSYTVEGLKPYRIYEFTITLCNSVGCVTSASGAGQTLAAAPAQLRPPLVKGINSTTIHLRWFPPEELNGPSPIYQLERRESSLPALMTTMMKGIRFIGNGYCKFPSSTHPVNTDFTGIKASFRTKVPEGLIVFAASPGNQEEYFALQLKKGRLYFLFDPQGSPVEVTTTNDHGKQYSDGKWHEIIAIRHQAFGQITLDGIYTGSSAILNGSTVIGDNTGVFLGGLPRSYTILRKDPEIIQKGFVGCLKDVHFMKNYNPSAIWEPLDWQSSEEQINVYNSWEGCPASLNEGAQFLGAGFLELHPYMFHGGMNFEISFKFRTDQLNGLLLFVYNKDGPDFLAMELKSGILTFRLNTSLAFTQVDLLLGLSYCNGKWNKVIIKKEGSFISASVNGLMKHASESGDQPLVVNSPVYVGGIPQELLNSYQHLCLEQGFGGCMKDVKFTRGAVVNLASVSSGAVRVNLDGCLSTDSAVNCRGNDSILVYQGKEQSVYEGGLQPFTEYLYRVIASHEGGSVYSDWSRGRTTGAAPQSVPTPSRVRSLNGYSIEVTWDEPVVRGVIEKYILKAYSEDSTRPPRMPSASAEFVNTSNLTGILTGLLPFKNYAVTLTACTLAGCTESSHALNISTPQEAPQEVQPPVAKSLPSSLLLSWNPPKKANGIITQYCLYMDGRLIYSGSEENYIVTDLAVFTPHQFLLSACTHVGCTNSSWVLLYTAQLPPEHVDSPVLTVLDSRTIHIQWKQPRKISGILERYVLYMSNHTHDFTIWSVIYNSTELFQDHMLQYVLPGNKYLIKLGACTGGGCTVSEASEALTDEDIPEGVPAPKAHSYSPDSFNVSWTEPEYPNGVITSYGLYLDGILIHNSSELSYRAYGFAPWSLHSFRVQACTAKGCALGPLVENRTLEAPPEGTVNVFVKTQGSRKAHVRWEAPFRPNGLLTHSVLFTGIFYVDPVGNNYTLLNVTKVMYSGEETNLWVLIDGLVPFTNYTVQVNISNSQGSLITDPITIAMPPGAPDGVLPPRLSSATPTSLQVVWSTPARNNAPGSPRYQLQMRSGDSTHGFLELFSNPSASLSYEVSDLQPYTEYMFRLVASNGFGSAHSSWIPFMTAEDTSSPESHKLKDPSATRAANLLSQSRKLIKCMLAFKGETNHEIEIEHLSFPKNLDL

SEQ ID NO: 5 - DNA, 152 bp, Homo sapiens
cttcctctccagaatcacacaagttaaaggacccttctgcaacaagagcagcgaatctactcagccagagcaggaagctaataaaatgtatgctggcttttaagggggaaacaaatcatgaaattgaaattgaacacctctcctttcccaag

SEQ ID NO: 6 - protein, 50 aa, Homo sapiens
SSPESHKLKDPSATRAANLLSQSRKLIKCMLAFKGETNHEIEIEHLSFPK

SEQ ID NO: 7 - DNA, 11020 bp, Homo sapiens
gtaagtggtctgaacaatacacagccaaatgtcttctacatagggagcttaaaatgtcttcaattttttccaaagcaaagaaatgagcctcccttatttacttgttgtttagtgacaataaccttttctagggcaagagagtgagcaaaggtggtcagtctctccagaaagaagaataatgtggtcttggagggttggagggttaggcctacagacaggacaaagtaattcactataaattatgatatggccccattctatccttcagggtacatcttagcgccctgcaagagaaaggttgtcatcttctgctttatgactgaatgttctctgtttcggagaaattctggcaggcagaagaaaatgaaatatggaccttacttcatgaggctgcttacatatacttgttcctggaaacaggtttcattttcctgcttctactcataccccaaagacagccttcagcatagagaagtataatctgatagcagtatattacaaaaggtggattaagatttctttattcaaccaataaagagaattttctagttgttcactaaaaagttatttttgcatatatttgctagattatatttgggaataaatacatgactataacatttggttttatacaaattacctctataaaagcatatatatgaaagtagaggggtttttaaagaaaagttagaaattaaatcaagctacacagagtgaataaggacattgtatctttgaacagttaggttttttgagttaatcttgtgaagtcttttaatcataggcttcttaggcaatgttctctgctggcccattgccatgctggctctatatccaatgagaacgttaagtgactttcaaaagcctagatattaacacaaaagtatggtatttgcaacaatatcaattgtttattaaatgtattgttttatttctataatacctttaattgcattattttagtgaagataagacatcaaattagacattatcagtacaatctatcttgtttaaagttgactttatttttacaaaaaaaagccacctttatgagcaataatgtatgttacttaattcatttcttccaattcgtaattactccctgggagaaagttagctactttgcaaggggacactcagtgtttttgttctcaagggtatcatttagtaaattatcagcacagtacgataaatggcacccaaagtccagaaagcattaattcaccaccttttaggaggaacattacatacactctggggaatctggacaccatgatcaccagatttatggactgaagacttcacactcaaaatagatttttgaagaaacatttgaaacaactgaagatagatttgtaatctccttcttatatatagcagcatgcttgatggcactaaataaagattagccaaaaataattattcaacccactgcagaggtgatggctcaatagaatgcttggaagaagggagaaagcattttttttttggcacagcattctttattctcctagagaaagggcaacactcaaacttcctcagcggtaatctccccacaattttcactgaatgagggccatgacctgccatctataggcagggaggtagcacataaataagcaaaagtccaaaatattgtaaaataccaattagcatagcatcctttgttgagcaaacttacctttggtctcctttttactataaaacaagccttatagaccacacatacacatcgttagaattttcatacccagagaccctccattgttgtggtatttagggcttgagtttaaagtgagtggtattaacccttcattttccttaagtaagaattagtaacacttgaataaatagcaggtatcaactcataaccattatttgtgtttaaatccgttccccaaaatgaatgaactcttccttcctctgctttgtgtatacactgtgaagtcacatacatagcaaagaactggaaggaggccatgtgtacctgcaggttacgttagcagtgcacctgagacatggtgacagggtactgtatattttagatgtcagtggagatggatgccatctctgaaaggatatgcaattgagttgacaaagactgagtgattggcattgggcacaagcagtttttctgtcaaggctacaaagcattgcttataaaaccacccatgttgacagctccatgccagaatcacacttcttacttgatcctgaccagcacctcctgctcaccaaagtgcaattttctttctctttctttcttctttctttgtttctttctttcccctctctctctttcactttctttctttctcactctctttctctttctctctctttctttctttctctttctttcttttcttcctttccttcattttttgagacagcgtttcactctatcgcccaggctggagtgcagtggcaccatgtcagctcactgcaacctctgtctcctgggttcaagcaattcttctgccttagcctcccaagtagctgggattacagatgcccaccaccacacccagctaatttttttaatatttttattagagatgggtttcaccatgttggccaggctggtctcgaactcctgacctcaggtgatccagccgcctcagcctcccaaagtgctgggattactggtgtgagccacctcacccaacccaaagtgcaattttcaatgtagaaatttcacatatcgtcttacagaacgaaacagagaagtcgcctcgtgcccacatttaaattccataccatcaacaggcacctttctgcatcagccacagcctcacagctttccagtgccaaaatgggtcaccaatggcaatatttttagtgtgacatttcaagacagtgattttcagcaagcctgtgacacaggtgaaaccacaaagagaaatctaggcaggcaatgagctacagccagagaagcaaatgcatgggtgcagagaagttatcatggacagggaaacaggatgtgaagaattttaatagatttttttttcaaataatttgtcatttacaccagtgtgccaccaatatccagttccatgcatttttaaaaatctagtgtgctgatgccaaataatcataatgcacatttcctatgaatattttaaatcctgttaaatgtgtgttaataaaagatgtttgttccagccaatttggtcagtgtagtgtttaactggttgcaaccagataaatacaaacaacacattattttttaaatgtgctgctggcagtccaagcacctggcatgtccacagcttgcaaaaatgtcctaagattatgttaggcttgggagcatgtgattaataaaatgaaggcacttgcctagcagctgaaaatgttgatatcttgaaaacaaagataaccatcactcctgattatatgattgttccttctctctcgtatgtttgcaattgttttctgtatagtacatgcatgtagaaattagagttggcagggagggcaagtttttcaaacctcagcttaaatgtggatgtattcttttgcctaccgaaatcctgccttgtgttaactatgaattaacctactttttcttaaaattgtggattccccagcccaaaaaagttagataatctgtttctcttaagatttcccaggaaataagattgaaatatggaatatctaatttcagtcattttaatgacaaacatatatggcatacacaagcaattagatcaactaatgaaattgaaatcattttctaaaaatcacttccctaccctcaaaaaaaaaaaccccaaacttgaattcactttagattttaacaatttagttgtcatatatttaaaaatgtttgatcgtttcccaaatttgtagtttaaaattccatatttatatttttaaccactagtctaagaggcactactgcataaaacctgtagaattcgaacagtttattctgtaggtttacttagacaacttttcatttgttcattattttgatgacacagtgatattttaagtacagttatatgctgcacaacatttcagttgatgatgaaccacatatatgacggtggacccataagatgatgatatcatatttttactgtaccttttctgtgttgagatacacacttatcattgtgtgacaaatgcctacagtattcagtacagtaacatgctgtacaggtttgtagcctaggagcaacaggctataccacacaaactagctgtgtagtgggctataccatctaggtttgtgtaagaacactctaggatgtttgtacaacaatgaaatcgcctaatggtgcatctgtcagaatgtattcctgtcattaggtgacacaagactgtaccattgccatgctatatttgctcattgcattacatcttgttattttttcacatttataattgcactgtgaacagaggagagggcaatgaaggaaattgtcttactgcctgggtcctgctttacttttcccctcagcaaccttcatccatccttcagatactcacagtaatttacaaaggaacagaggttcttctggagtaagacagaaaggcaatgtgaggtcaattgaaatctagatctaacagaacatgcttcttcctcttttgttgcctgacataattctacacattcatcaagccccagctcaagtgtcacttcctctgtgaagttttccttcttgttgctcccttagaattttggtttgtgtttactagtgaatcatcaatatccccttctgaattgtaacgtctcaagacctagggatctgtctcaactatctttctatcaccagtgtctggcgaagggtctgatatagagtaggtgccccaaaattcttactcaaagtactgattaaaagcagagtttgattgaagtaaatccacaaaaactcaatcaagcaaacatttaccgtgtacctactgtgtaccagggactaaaagagatatgaaagttgcaaggatggatatgatactgtttttcccttgagatttcctctgtctggcaaggagcacacacagtaaaaccatagttagagtgaaagagctgagttgtccatgagagcaagctcagaggaagggcatggcccctcaacatgagggccaggaaagcctacccagagaagaccaggagaggaattggaaatgatttatatttggagtgcactttaatatcaaagttcaaatttacaccatctccacttgttcagggtaaggctggaaagcaattgctgtaagagagcactgacatatgagacctgaagagggactctcaggttgtcctgtcggtcgttccagcctctgagtatgaggcgaggagggtggggacaagaggtgaatgtaagagagggacatcccaaaagtgattctcatttttttaccttggtcagaggcaggcttctggctgtccctctgattcaatattggctgctgtcttggctaggttaacgaatgttctagttagagaggcttctgccagccccaaatcatgtgctattcggaatgaaggggagggatgtgtagaaagaattctaaaacaaaaccatttttcctgtttttattctcacaacctgtaataagagtaaaatactctgagaccgtgtaacagaagaggaaggaaacatgtggtataaaatttgataaattgatcaagataattctagagtaggacttccgaatcatttaagtgcacatatgcccttaagattactgaaattttaaaactaatattgcatgacaaacatcttatgtttagggcattttagaatttaaagtttcacttgcatccttaaaatcattctacgcaacacaaggaaaatcggaatatttttaaatgagagtggaacatatttatatgagtacattttatttaatgaagaaagaggaactacaagtttcagtagtgctacacaactattttgctttctccattccaaatatttttccagttgccttaagtactaacctctgattgctgacatgtttttcctttcaaacagtaattcaggtatctattttgcatagaacagaagacccatgatcaaaaataacatttataatcttctgattttgagagcaaaatggttctgcatgttttcactacatactttgttttctgttgcatagattttctccacaaattcctgaattttcagaattaacaaattcaaatatttacaattatttttatattttatttttataatgtaagatcaaaaggaacttattcaagccaaaaatgaccaatacggaatcctttgaaaggatggattgattaatcaaaaattctatccaccttgcctcaatttcccacttaagctctcgaatctcccctgggcacttaaagcacactcctcttccaaatatagagtgcttgtaatgtctgtgtttcttacagctgaagactgcaggtgaaagtaatgaaaaatcaagttttttatgtttactttaagaaattaatgaaaaataattttatcatagctgccttattatcactacttaaattttattgagggtgtattatatgcaagacactttagcaggaaaagtatatcctctcattatccagaaatgctatctgctggccttccactatttttaaaaactattcttgttctttagctttgaaaaagttaaattgtcaatatttgaaaactctcagtggactatgtgagatcattcaaagataattgccacaggttgatatttaatggcatgagtttagttttaattctcaaatcttaaattcttagagagtcaagtatctaaaaactgctggttattaacaaaaagatggatgtttaccataatcattttctatagcattttctatagcacctgcctataaaagaacattctgcaatgctaaaacaatacatagattcatttaatcttgttgtcttcctcattttgataatgtacctgtaaacagagttgatttgctatatttggaataattcagataagttttgcccaaatataaggagtgaatgtgatgacctttaggttttttaggatgttttcctgacttcatgaattctcacatcaatgcattttattttctgcaccaaattatcgcagatgcatctactacgattcaccccacaatatgccccagctctagaggttgaaacattctttctaaacaatactctcctgatatcaggagaaatagagaaaaatagttcccgaatattggttctcctatttgcaaactatcaaataatgtccttccaattccaacagccttttagccttcagaggtttctttcattaaataatgttacttatgttatacagcccatttccttttttatcagagtcaggctgaaagttcatttttctgcaaaactgcagtgcccattcttaatttttgttttgagaaataactgttgtaccctctttattatcacaagattaataatatttctttattttattgctcctcttacatttggatcttttattatgagctgtcaaaaattcttttgggaagtagttggggtataaataataaatcgataaaagaattcatgattaaagacaagatagaatccattattctgttaacatatcagtagtgaataacaaaaggctacattgacaattagcatgcaatatattgctttatataattatacatccatatatttgccactttgatttttaattcactggtaaatttaggggatactcatttatggagttaatattaccaaaaagagtttttaaactgagcgaggctttaattagaatggtaaaatattgcttcagggcaacaatgagaatgtaacaagaaaactgactgatcagtcatgggtaactcgaatagcaaacaagtagagaagactcacaaaaccactgaaagttatatacacactcaagttgtgagtcattcaaactgggtattcatacacatgtatacaaatacaaacaagtgtgtgcgcacacaccctttccaatatacacacctgaatataaaactaaataagcagattcctctgttaacaattttattactctattttaggctggggctgaacttttgaagctgatgagcaaaatagtttcccataaaagataatttcatttgccaaaatgaaactactttccgttattaatgttgcaatgaaatggtttgaaatatgagtctgtgatctggacagaaaggatgctcctgttcccagctccaagagggagttctctaaacaattacacccacggagagcgctgtaaggttgtattttcatcaccggccagctgagctgtgtgcctgtcatactcccagtctcccctccagtgacagccgcattgacaacatgttatactccacattgattttacagttaaggagctgattgtgatatatagagattttaagaattcagctgagaggctgacttttgccttttatcattccattaaaattttataaccatctttttcatgtcatttcatccatgaattcttactttagaaagtgatagctactgctgtgagcataacttttctcatgttcagagctttttattgtattagcaaactaccccaattatagttattactcatgttttacataattgtggtggccctttcaaccatgcagttgcaggccagttgatttgtatatagaattagatgattcggcttatcattttaaagcactaaattgaaagagtgccaggagtcaggttttaacacttccctagccaaaggagctaattaagctgctttcagcttcctctccagaatcacacaagttaaaggacccttctgcaacaagagcagcgaatctactcagccagagcaggaagctaataaaatgtatgctggcttttaagggggaaacaaatcatgaaattgaaattgaacacctctcctttcccaagataagagatcatctttaagaaaaggctgtgtattgtgggggtttgaagtgcaagttcatctcattatcatggatgtttcacccataatactatcatcatatgcaggagaaataaaagccttatcccccaatcacagagaacaaactgcatcattgttgtttcttttccctgaagatgctcacagtttgatagttcacatatgaggaataattatgcaagacccagatgaaaaccctaataaaaaatattctgatttttaagtgtatattactctctttggggaagagagggtgagataaggttagacattaaagacttgaatctccaccattgattttacgaaacccaatctcaggggatttgggggtttttttagatttcaaaacaacattgatatcttacaagactcgtacttgcttttctctgggaaatagccaaatctagatgacaagcataaataagaaaggagctgtatccccattttgatataataattgctactgctactgtataccagagagcaaaagtaagaaatggcatagtggttttaagaaagctttaaaatgaaagctaacaagagactgaaacggaaagtgtgatttataccatgactgctggttttagggttttttttagggatttctcttcaaataggatacattaccaaattgtcagaaatagcttgatttcagagttagtgcactataacatcttttgcttcgaaaagtgattatgattctaccatcagtccagttggtgacaaatacgtggatcctgttgtgtgaaagtgtactcatataaccaactattattgcagtcactggccctgcaaagcagtggttgcatttaaaatttcaaccttctttgtaacactgaatcgcatacacacactcacaagatcaacgctgttttaaacaattactaaatccaagtatatcttttttaaagattttcaataaaatctaatgttcacagaaaaatctcataaatgtcaaaattgctgtgggcagaaaaggggggatacagtattttcttgatctgttttagcaatttatagatttcaggccgtggtttataagaatgctaaatgttctggaattacagctgttactgatcagtgattgagccagatttgtgttattgcaccatgttcttgcttgtacctagagagcagtaaagcctcaatataataaaaagcacctgcattttaaatgaaatttcaattgaaaaacttaacagcccttcaaattgcagaatttaacgcagcccagtaaagcttaaataacactttgcccccgcaggctgaggggtttgcattcaaggtgacttgattgtgtcgcatggtgaaattatttacaattaaggaatttctctggagggctgcagaatatttgctgttccacaacacctatgcaggcatatggtgggcctttttcagtattcatggagcctcctgaacctttatgataattgaatcagttagagtgctgagtggagcaagcataaaacctgttaacctaaaggtcagatctgtgcattgtttatttatcagtaggtgaaagagctaaatcggcagcttctgtcacagccacagtaaaaaatcgcctataatattaacagggagtagataaattgcaaaacatggattagaatgataaacagaaccaagtataatatagaatatataatgagagatgctgaaggattttactgggctgtaaaatatgcaagtttgttatgatagtgttattgattataattagttactggggctctagaaaaaaatgtaggggaagctagaactttagtaacaactaccctcttgtatgtttattaaatttatttttttaaatcctcattttttaaccaatggcttgaataaaaagacatgattttgataaagctgtcttagagaggaaaatgatcattttagtttcataatattcaacaagtatttcacacgcaaaatttatgagcaaagcaatcacagtccttgtctttatggcacttatttatttacttattggcctttaccaagtgttcattttcatatccttgtagcagagctatcactcattttagctttgaggagaggtgggacatttccaagaggtctgactttctggatttattttactttacag

SEQ ID NO: 8 - DNA, 800503 bp, Homo sapiens
tgtttgctctgcagaatactttacctgggcacccaagtcttccttccagcattcctgctgctacagcctatttgctgagtaaccaggggttacagcagcgttgccaggcaacgagggacagcggtcctgttgaagagccatttgtcacactgaggggactggttgaaatgcaataaagaaatggtaactcagcttatttatcaatacaattacttgcacagtattagggatccatgtgtaacctacaaattcatagtcatatgaggaaacacagaaacattttgctaaatattaaagcataggacagacagatggtgttgggtttctaatcagctttactctgagcttaaagttgctgcacatgctgggataaggggaaaggcccaaagtcctttgccagctttattttgggcatctgtaagttagctctgggttacaatgtacagtgcatgtgtaaagaaaatctacaagattcttttccctgttaagtagagctggtaatgccattgctaattccctggggtgaagtaacaacacaaaattattgtatgtgtaatatattattaataattatatatatataaaacacacacatatattatataaatatttatgtataactggttataaatattactggttgtcctgtggacttataaagtgcttgatttgcccaatgcaatcaagagatttaccaaaaggatgagtattttactctgagcactgtgcttcaaaatgttttttgagaagttcagtagtgttgcttctaggagctcaaagtcctcaggcctgggatgagcttcagttttaaaggtgcagcagctttcccttgacgccctacgtttttgattcccagataccagcagctactcatgtcttcgccattgctaagaacgtcgttggtattaccttactctgagaacgtgtctgcagtttccagaaaatggagtatcgcaacatcacttaaagtaccctgcttcaaagtattgctggcaagtggcgtgggcctgattatttatttagaaatgctttatcaggaggagaatgcttttttgtaaacatgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtaagtagtagtgtaggtataagctttcataggtccccaaaaccagtagtagtgaagatcatttcagcctgaattccaaaccggaagtgaaggctatatagaattcatggtattgaagactaactcttccagttgtttccccaattaaaatttttttctcttctatggatgaaatggaccatgaaaaaaaatgtgaaaatagtttatcaaaggcaaatgtgtttatgcaggaatcatttattttctatagcttagcgcgacctttggtcttagccttcaaagcctaaagaagactcagagtgagttttaaggcatggaaacttgtaattaatacaaataattaatattttcaaaatcttgaactgggtttatataatcaacatttccttactagggtataacattttcattaggcagatagttctcccagtccttgggactgttttcttcatcctcgtttccccaagaagagctgtttgtttgactcatggaagatgttcagtaatataaattgaatatataaataaccctccatctctaaaaacatatagcttttagttctttatcttgtggtattttcattttccaattagttaggaaatatgtaggtaagtgtgagagattctcaaaagctttcatgctgttcatcccagagaaatgccttcaatgagtctgggtcttattactgccattttttgttatttaatcaccagtttttcattctgtaatcttttctcaagctgatatctaatgagtttcttctaaatatttattgccaacctggagattttaatatacaggacagttttgaggaatttttgcttatcttttttcttcctagagggcttttggccctttctcttgtgacattttctgtgtgtgacagcgttggctggatatctaaaaacttgtgaaacaaaccagaaaaggattacaatctcataagcaaataggacttaaatgtttttggtgtttagtttcaatttgccaagtgaaagttggcatgtcttcattttgttttaaatttggattaatcacaaaattaatcacaaaccattcccatttctacatctctcctcaaagaaaaccttgttttcttactgtttgaaattctagtaaattcaagctactcagtttatataattaacatctgaagagtcttaaaacattgtcttttgacaaatagggctaagataaaatatccttctgagcttgtagggacatatctgtaccaaattcatcttctattgacatcattttgtataaataagacagagaagtatttacagggttggaagaacatggttaatggttttgagagttccttgtatcaaggtcgtttccattttcaaaattaaaatacctttgggaattgggggaatttcggggtgtttgcactagataagtaaaacaaacaaaacatggattatccaattattgtttattcaggagcagaataaatccagttcctaaatattttgctacctgccttcctctcacatttattatctaccaaagctagtatgtttacaagcaaacaaaatagcaaggaagataatcaataacatattaagaaatgcattttcagtaagcttgggaaaataagtctgcatttggtaaatacattcttgagtaatggtcgaattctcacttgtagatttaaacagaagaaaaatgaataggggcaaactcttttcaggttaagacctgatgggtagggataaaaacaaattcacttcagtaaattagaaatattcaactactgaagggttaaaaatataatttgcagtagaatttatataaaacttttatttctacttatataaaacctttatgtcatctaaatctatttgcctaaattaaaaatatacttgcactcataactttataccaaatatacatacaaaatatagtaaaattgtgacagtaaatgagggactattagtgttttacaatcttattcttacctcccaactcaggaaaaaaatagatgcaagtgatagatgcaagtgagaagaaattatgtgtgaaaaacatgccctttaaggaaagctttaaaccatctttagcagtaattcttgattggctcaattttatacatttgcctctctgatacttcctaccaaatttgatcacaaactcatcattttttgagagactactgtatcctaggtgtttgtgtgtgtatcctcagaatactcatgatctaaatgatctaatggagtgtacagatggatgagtgttattacctaggcagcacagtgtgttaagtgagcacaaagtgagacccctcaaccgaccctgagcaggaagaagggtgccaggaccaagcataatcattcagataccaaagctaagtaggaggtaaccaggtgaagaagagacctcaaggtctgaaaggtgtgtcactctaataagggtagagataacttaaaataatttgataactgccctgacacaagacctggaagttttctgaaaactcttctagtttttcaaaatcttatttcactgtgttctagaaggctgaaggacctttcacctcagatatttaacatgatctcagtacctcagttggactgtacggtcatggagaggtagccagtcatcttacagacactggctttggctttgtgccagttgatgatggggtgagtagagactatagctgtccattcttcatttcaccatgggaattaaatagagtgattctgacttcagggctaccaatttagagccttccatggacactaaatttgctttacattaaaaaaaaatttttgcactgatgacttaatactcaagcggcctgtagtgtgttgtaccacttcctctaaaagaaatagcaggagaactaatgagccaataacctaaatgttagttttgcagaatgattcaaccactttagtttccatcatgaatctctaatgaagggtgctgaggctctggggaatatattgtaaataagaattctattttttattgaaataaaggggcttcttcattggaataaagctttcattgaatataatgacattcaggcacttattcatagtacaccattttgagcaaagtttgaggtcattttaacaccactgtaactgcacaataccttagcatgtctttttggttggatgctgaccttttctctcttttccggttgcttcctaaggtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgagtaaaataaaaaatatttaacatttggttaaacacaaggatttgtcttcctttctctcttttaaatggcatctactcacaaaatctgcagcagtatcttttagatttcaggtgtgtataaatgacaactaaagaagaaaaatatttaaatgacctaatgatgtatctcttgatatactagcatttcctcccccaaaattgctgtaaaagctctcacagaaacttaaagacaatgctatctgtaattgtaatatcctcagaaaatttttgttttcttgggttcgtatattctattttgtttaaaaatgtgtaagggctcatttgatgtctggtactaattttactagtcatggatgtattaataccccagcttgatttttacatctgtctttctcagcagctgatgatgtgaataaaatttgtctgttgcattaaaatggtgaccttagaactaatgaactttacacttgaggcactcaaaaggtgttatattattattttagttgtcaaccacagtttgtatgagccttagaagctgctaaaggctgagagagctgtgacatgtctggtatttacagtctccagaagagaggcacagttcatccttttgttttttcagggcactggaatggcccaatacagttaaagccacacctgcctttcaaaccaggtgtattagtccattcttccactactataaaaaataccggagactgggtaatttattataaagaaaagaggttcaattggctcatggttctgtgggctatacaggaagcatgattctggcatctgctcagcttctggggagaccttagaaaacttacaatcacggcagcagacaaaggctgagcaagcacttcatgtggccagaatagggaggaaaagaaagaaagggaggtacttcacacttttaaaccaccagatctcatgagaattctatcaggagactagcactaggtggatggtgttaaagtactgatgagaaaacgtctacatgttccaataacctcccatcaggccccaccaccaaagctggggattacaattggacatgaggtttgggtggggacacagagccaaatcatgtaacttggggtgctgggtaccacagtttccagtatgagctctcatatgagcatccatccagtggctcatgtgaacctcatttgaactagaggacatttacatccttgttcattttataaaaattatctttgatttctcacttttttttttttttttaatcttgaagcagataatgagtgtgcgtcctcagagggtcttgataattgttcattgttttggctttcagatactaagatatgagtttagcaaatgtgattggcaggggtcagagttttcatacacaactagggttgaaatgatacacaaaggggacgtcatgtctgacgtcaagccttgtgcataggacatgatggtttctgattctcaatgcttattctccatgtgttcagtagttaacagataggagaccaatttgtcctagtcttgaagtttccattgtcttgaagtctccattctgcccactgaccagtcctacagaattgggttttaatattaaaaacgtagaaatagaaacttttaaagacagtgccatctttgcagaagatgccaaatagatatgtttgttgcatatttttgtatcaacaatgacaaaaaaattatctttacttgcctttattttgtgttatctgtgaaactgtgccatgttttggcaggcagtagtacattaaaagcttcacaaagaaagtttaaaatctaaatgcagagcggtaaccatgactgaattactcccttggggataaaatgctcttagagtgcctactgaaatcagcattatcatttcaatacatgtcaaatatgagtcatttactagtttaggcaaaatttcttcatgaatctttaaatctttctcttctttcaagaaaaggttaaagtacttatgatttaatgagactgctttatttcataactgtttgactatcaagagaaaacttgtccttttcgatttgtacactcttttatttatttttttgcataagttttaaactattctgcattttatattaaaactacagaactaggcagtcacaaaatgttagaaaaccattcagatctgtcatttaatcatctagcacttattaaatatttgaggggtatgcagcattatgggaatctggatttattcaaatgaaaattaaagagcaattatttactctaaaatggagctctatataaggttcctttatattggacaacagtctgaatatgtttaaggtattatgaaatttataaaaatccatattatagatttttttttgagacagagtttctcccttgttgcccaggctggagtgcaatggcatgatcttggctcactgcaacctccgtctcctgagttcaagagattatcctgcctcagcctcccaagtagctgagattacaggtgcctacaaccacactggctaattttttgtatttttagtagagaaggagtttcaccattgttggccaggctggtctcgaattcctgacctcaggtgatccacctgccttggcctcccaaagtgatggtattacaggcatgagccagagtgcccagcctagattttgaaaaaggaatgtactgattactcaaaagttgttataagaaataatggaggccaggcgcagtggttcatgcctgtaatcccagcattttgggaggtagaagtgaacggatagctcgaaccaggagttcgaggccagcctgggcaacatggcaaaacctcatctctacgaaaaaacaccctaaaaaaattagccaggtgtgatggtgcgtgtctgtagacccagctactcaggaggttggggctaaagtgaaaagatcacctaagcctggaagtcaaggcttcagtgacccatgatcatgccactgcattccagcctgggcgaaagagcaagatcctgtctgaaaaaaaaaaaaaaaaaaaaaaaaagtgacaggaaggacaggagattaggagttgggaaatctgatttaggttatgctactctgtagtcttaagaataaaatttataggaatccatatgatagttgtttaataaggaatgtactaattgcttaaacgttgttataagaagtaatggaagctgggcacagtggctcacacctataccctgcccgccttgacgtctcaaactgagtcatttgactcagttttcctatttacataagaagattgaactagatgaacaaaatgagggccttttgaattcttcataaacaagtaagtggagtgtggagtgtagcacaagtcattaaagtatggcaagctgttgagttgtgtagggttatttaggtagtaagtgacagagccagccccattaaccaatgatcagtcttgtgctttttttctcttctcccatgctgcttggcatttacataaaaacatttttttgctagattttctggacaaaatatagagaaatgtagattgttactattccattgtataactgcaagaacatttccagaaaaaatattttagtataaaatgtaacttactgttgcatgattatataatgcatctaaactccatttaatttggggattagggacttttatcatgctgggcataggacagaacaaatgattaataatcttgtttagtcaagtttcaaactacaaacctgcactttatgtatatgtggattttcacccatcttccaaatggccacaaattgatgaatttatatagtgtgtgtgtttctgtgcatgtgaaaaaataaaacatacaactctattcgtggaatggcccagaaaccagaattttagttcgttgcttatagtgattttttactggttagcttatacctggtggcataaaattaattagcagatctcaacttatgctttatctcagacagttcacttgtatcagctttccatcagtaaaatcagaattctaatttaccaaaatcagaaaaaaaattattttaaataattaaatatctgggggaaaagatgtcaggaaatccagacataccaaaattggaaatcgaatttcctaaacaaacaaatagacaatatgctcaatattgctatggtaatgaatctcacagcttttattccaaaactagcattttaaagtgtcaatctgttggaaaatgattagtgtttaaattaatattcatttatggacttgaatctgacaggattgccaattgaaattttactttggggtttaatatattggctatttcaaattatatcaagctaaaattcattgtgtcattttttatactaaaactagaaaaaatcaattcatagtttttattatcatatagggaacactgatcatattagcaaaatttttaaagcttagttttcatattaaatcagcacatgctgtagttataagatttcctttggttactcttataaaagttttgaaatatgtaaaaaaatttactttagcatttcgttatggattggtaggtaaaacaatatggaaataagtatatgtgtttagtggcatttcatttaaaagtaaaactttagggttttctttgacaatatattttgccttaagcagttccacacattttatagcccaaatagtgtcaaagaatcatcagtatagtcatccttctagtaattatgcagaattgcagtaaaacaattactacgatttgaagctgatgaaatactacagctgtggaaccaagaaatgatttagcattgggcttgttcacattttctatgctattttcagggctccttgatacattgacaattcaagagccatagatgactctagctacaatagtgtgaaaaagagcagttctaatatgatacaatgaagaaaaaaatgcatgggtaaataaagttttaggaatcaatatatgaaggataggagtttcataatcacagttcatgaagtatgctcttttgatttatgtattcaatctaagaaagaaaaactattgatagttctggaggaaaacaaaatgcaatttaaccaacatttgttagaatagataaaccaagtctctcaattaatctctgaactgtatgcccatgtgcacactttataaaggtgtttccatgttcctattgattgagggaacataaaacatccatgtcaccttatggaagcctcctcattcagttcagtaagctttatggcatagaattgtcataggaataccatcccagccccactcccattctaagagaatctcaacccatattatttctttaatatatcattgcatttagctctgactctgtgtgtgtgtgtatgtgtgtgtaagtatgcatgcatatgtgtgctaaatgtttctttgtgcaaagccttctctttatatctagccagctgggttaacagctcaagttagttgaatagttttgggttattcaaaataaattaagatcaatagaatataatgaagtttttcagaacaatcagttacaaattatcatagctgctattaatcattgatttatgtgcactatattaaacatgttacatatttgcagttatacaatgaaatagtgacatgcttgtaacatgtttaatatagtgttaataatagctctgtgccactgacttatattatctccatgacagagattttaaaaaattagccttaggaaatttaaactacctgcctacatttatagtcccaagcttctctgaccttaaactaaaagtaataacttgccatgaacatgggtcactgagcagatctaaataatagtttttaaaattctccaaaccaaaaaaaaaaggcacagaatcccaaaagaactgaaaacatatatttataatgtaaatataattttgtatatttatacatatttgtaatataaatattttcaatgcttcagatatttacatgatttatacaaataattaaagtcaatatattttttaactatacccctcattgatacaagcaatttaaatgtacaacagaatgtaattttgtataaagttctgcgcaatattttcatgttttatggcagttgcgatagactacaatggcttaaagaaagaatatttcccttaagccagcctgatcacctgacccatgccttatagaatcaacccttattacaataaaatacaaagaaggaagcacttcctactttattatggaagaggtaaaaccatccaagtaaaaaagtaattattctctgtacgttttttgcatgtgattttaaaatgcaatatttaagcagaaggcaaggctttaattcttgaccttttagtaaaaaattgtgcaaccctgggaaaactatgtaactcctcaaaatgttaggatacccattacaaattggaaacaaacaaacttggcctatttagcttacaccataaatttgaacatataaagaaaatattgtctactaaaacactttatagcctataacttcctgctatgaaggagcttacagtctcttcagaggataagcaatcaaataattacacaaataaaggcaaaattataattgtggtaagtgctacatgatcacatgaagaatgatttggtcaaaccactgaagtcaagaaaagcttccttgagtaaatgttattgaatatgtgtattagttttctaggcctgtactaaaaaattatcacaaactggtggcttaacacaacagttaattcattgttgaagagttctggaggctagaaagctgaaatcaagttgttagaagggccatgctctttctgaaacctctagaatccttccttgtctcttccagcatctggtgtttgcacagacaccagagtatgtgattgtgctacctcctggggtttgtctgcccacagcaaggccgggaacccagaaaagaaaagaggagtgcccagtgtagccaccacccactgcatgagaaacagagctggcagcaatccttgatgctccttagcttgtagctacatcactccagcctctgtctgcattatcatatggtcctctcctctgatcgtgtgtgtcttctcttcttataaggacatcagttgtactggattaggattcttcctaattcggtaggactcatcttaacaattacatccaaaaagacactacccaaataaggtcagagtcacaggcacatagggttagggcttcagtatgacttttgatgggacacagttcaactgatagtaagatttattcaaaagaatgcataggatccaactgggcaaagagaattgataagaacattccataaatgcatagcaaatagtgtaaatgcccttgtataaaaagaaatatgttacatagactaaaaaaccaaagtggttagagtgtcgctggcaaagtgggacatggtgtgaaatgaggacagaacagtaggaagaggctatgtgttaaagagaatcactggatatgttaagattttttttttaaatggaactctattgaactgttttatgtgaaggacaggagatgagggatgaggataaggaaggaaaacgtatgatatgcacagattattttttcctaaagatcactttggctgcagtgagggagaatggtttgcttgaagacaagtgtgaagggttgttatggtattttcatggaccaagtcagatgtaagtgttacttacttacagcatgaagacaatagtgaatatgcaaatgaatggtcagctttgagaggagtttaagaattaaattaaagggcttgttgatgaaggaatatgtaatatgagggaaagggagttgatgaatcccagctttctggcttatgtaattgcaggtacagtgatttctttttctcaaatagaaatactggaagagaatcagattttggatgtggagcacatatgaattagattccagtttagggtaataattctcaactatagaaattattagcattattgagaaactttaaaaaatattctgatgtccatatccctttatgtcttcattggtctaggtggggcgcaggcattatttctttctttcttccttccctgatggatttaaaaaggtgtaacaaaagaaaatatcagtctaccattgatgagcatttaggttggttccatatctttgctattgtgaacagtgctgcaacgaatatacatgtgcatgcgtctttatgatagaatgactcagattcctttggatatatacgcaggaatggaattgctgggtataatggtagttctgttttttttggtctttgaggaattgtcacactgttttctgtaatggttgaagtaatttacactcccaacatcagcctattaagcattcctttttctctgcaacctcactagcactgttgtttcttgactttttaataacagacattctgactgatgtgagatggtatctttcattgtggttttgattgacattgctctgatgatcagcgatcatatgcttgttggccacatgtatgtcttcttttgaaaagggtctatttatgtcctttgcccactttttaatagggttgtttttttcttgtagatttgttgaagtttgttatagaggccagctatcagacctttgccagatgtatagtttgcaaaacttttctctcactctataggttatctgttcactctgttgatagttcgttttgctgtgcagaagctctttaatttaatttgatcccatttgtcattgcttttggcatctctgtcgtgaaatctttgcctgttcctatttcctatgtccagaatgctattgcctagattgtctttcaggcttttagttttgggttttacgtttaagtctttattccaacttgagttgatttttatatatggtataaggaaggggtccagtttcaatcttctgcatatggctagccagttatcccaacatttattgaatagggagtcctttccccattgcttgtttttgtcagctttctcaaagatcagatggtggtaggtgtgatggccttatttctgggctctctattctttttcttcggtctatgtgtctgtttttgtaccagattcatgctgttttgcttactgtagccctgtagtatagtttgcagtcaagtaatgcaatgcctccacctttgttatttttgtgtaggattctctgtctatttgggctcatttttggttttatatgaatttaaaaagtttttttctagttattccaagaatgtcgttgtttgtttgatagaaatagcactgaatctgtaaattgctttgggcaatatggccattttaacgatattggtccttcctattcatgagcatggaatgtcacacaaaccaatgatatctgtttgtgtcatctctgatttatttgagcagtgctttgcatttctcattgtacagatctttcccctccctggttaactgtattcctggtattttattctttttgtggcgattgtttcacctgcttctaatcaaatctatttagtagctgttattaaactgtgtagccattagtatacagtagtactccattacccttggctttgctttctgttgtttgtcacccacagtcaaccacagtctgaaaatatcaaatggaaaatttcagaagtaaacaattcataagttttaaattgggtgctgttctgtgtagtgtgatgacatgtgaggtggtcaccatacctcctgcctgggaggtgaagcatccctttgtccagcagcttctccatattgtctatgctcctagcccttcagtcacatagtagctctcttagtaatcagatcagctgttgctgtatcacagttgtaacttgtgttcaaggaaactgtatttcacttcttaatggccccaaagtgcaataatagtaatgctggcaatttggctatgccaagaagccataaagtccctcttttaagtgaaaaggtaaacactctcaacttaacaaatgaaagagaaaagatcatatgctgaaattactaagaacttcagtgtaagaatgtatcttctgtccatgaaattctgaacaatgtattgttataattattctattttgatagttattgttaatctcttactgggcctaatttataaaaattaaactttatcttgggtatgtatgtataggaaaaaacatagcatatattgggttcagtaatatccacggtttcaggcattcactgggagtcttgcaacatatcctcaatggataaagggggactactgtatgcgcaatatatgtatacgcttaaaaagagttttgtttagctagtgtgtgtaagaagattatcacaagtcacactgtagtgtttgccttttgccagtctgaatgttatcatcagtctaatattttatagcaaagatttaagttcattgaaaacttccctatggaaacacttccaatcaagacctacagcaagccatgaataaattaacatttaaacatgaaaactgatatttgaagaagaattagcaattaataatttctgctagaaaatggtggtttctcagccaatagctataaattgtataatatatgtaaaaggaaatatatacaaatatcatatgggacatatatcacatatactactaaaattgaaaattgctataaatagaagactatgttccaatgtccactgatttttttttttttaacaatctctagtcttgaaaatgccactatggtaattctgtcaaatttgtaatggttgggatttgatggtagtgcttttgaaacctgtattatctaatggaattgtcatttatattatatcattttcacctaaaagccaaatacaataagacttaaattatttttgctttttttgtggatagtcatttttgtgcccaaagggctaactgatgccttcagttatacatgaacaattcgcactaacgtcaggaagaacagtgtgcatataacctagggcagaatttggtctatggaatgtatcactcagtagtggaatggagattatgactttatttaaacatggacttgagtagttttatttttccttactgtttcccttggcatttctttctctaaagtgcaacattcaaaagtattctatgcagctgtagtgtcctggatgcataataagggcatatgttcaaggcaagtttaaatatccacataagccaaagacagagtaattaacattaaaaaaattaagacaacttttccaagaatgaaaagctttaatagattagctaattttagaattatttaacaacaactgtgaaaaattattagtatttacaaatatgtatatataaatatatgtaatgtcttatgttagacagcaatttcattctgctctctaatgattacatgacatacttctgaaaaaagtcaaacagtgtgttctagaaggacaaagaaataattggttcagttttgcttatacttagtgttcaattgttatcaacctggggtgggaggaagggaaagaaagagggaaggacagaagagagcaagaaaagaaggaaggaggagaggaaggagagatggaagtcatgtgacatagctagggatttggggcaaaattcaagacccatgttttccttgatggaaagccaaggaacctgagaaggagagtcagcccatgccaatttcactgtggtagaggtgaccaagaaagtttacattatggatgtatagtaggtaattttaggttgtttttgtctgggatataaacccattgtgttattccagttatttggccaaaatgttccatgcaaccattttggagtgctagcactttagggaatttataaaaaggggtggtgttcagtgtctgggttgaatacaaggtaggtagaaaaggacaatcaaaggaattagctgcaaatgagatgaaatctatgggaacatatattgagaaaactagtgaccattataatttaatcctctgaaatacctgcaacaatctgagaacaaggtaggtggcaagatgcatttataaatattaaagaaacacaagaccccatacactttgaaaactggggagtaccgaacttggagaggtctagtataggtagtgcttgttggtttgcatatttttaaaaccactttattgaggtctgattgacatagaaaagtctgtccatgttgcatgtatgcaacttaatgagtctaaagataaatatatgcccatgaaagtatcaccataatctgtggcataaacatatccacctatttgtttattcttaattaaactttttcctgagataattgtaggttcacaggcacttgtgagaaataatacagaagtcccatgtaccctttactcatttgttctcatcagtaacatcttttataactatggtacaatattacgaccaggatatggacattaatataaccaatattattcacatttcccatttttcatatattcctatgtgtatatgtttagatccatatgattttattaaaattttatccaccacagccgagttgcagaaaagttccatccctacaaggacacctcaagctgcctttttataaccatgcccactgtctcccttcccctactgctgccacaggtgtccctaacttctggcaaccactcacttgtactctatttctaaaatttggtcttttcaaaatgttgtatacatgacatcacacaatatgtactcttttgggattgtttctttcttttttactcaacataattccgtggggattcattcaagttgttaagggcattgatagtccaccttattgcagcatagcattccacggtatgtgggtaccatggtttgtttaacccttcacccattgaaggacatctaggttaattctagttttgggttgtatcaaacacagttaaagcattcgtgtggatgtttttgttaacatacatattcgtttctctggaataaatgctcaagagtgcaatagcgtatggcagttgcatgtgtgtgttttaagaaactcatttccagagtggctgttccattttagaatcccaccagtgatgtatgagtgctccagattgtgcacatcctttgtagcatttaaaataaaggctacatttattttactatttaaaataacattttagccattctgatagataatatatcactgtggttttattttgcatttctttaatgactaatggtgttcagcatattttcatgtgcttatttaccattcatatgtccaattcggtgatgtctccccatgtcttctgcccattttctaatttgattgcttatttgtagcttgctgtttttattctttttacagggttttgctgagattgattaggtccaatttatcaatctttcctcttatgtattgtgttttccatgtcaagtctatgaagtcttgcctaaccctaaatcctgagtattttttctaaaagattttttttattttatattgttaaatttaagtatgtgtttcaggccaggcatggtggctcatgcctgtaatccccacacgtcaggatgctgaggtgggtgaattgcttgagcccaggacttcgagaccagcctgggcaccttgtctttacgaaaaattggctgggcatggtgctgtgtgtctgtagttccacctatgggggaggctgaggtgggagaatcagttgagctctggagtttgagaccagcctgggcaccttttctttacaaaacattggctgggcatggtgctgtgtgtctgtagttccacctatgggggaggctgaggtgggagaatcagttgagctctggagtttgagaccagcctgggcaacttggtgaaacctcgtctctactaaaaatacaaaaacaattagccaggcatagtggagtgcacctgtagtcccaactgctcaggagctgaggaaggaagatcacctgacctcaggaagttgaggctgctgtgagcagagatcatgccactgcactccagcctgggcaacagagtgagaccctgtcttaaaaaaaaaaaaaaaaaaaaagcctatgtttcactttgagttaatatttttttaaggtgtgagatttggttttgagcagtggatgtccaaatagcccttagttgaaaaggctatatccttccttcactgaattgctttggcacatttgtcaaaaattagtagaagatatttatgttgatttatttcagaattctatgtatatccttccaccaattccacatgttcttgagtactgtgagctataatatctagtagagcgactccttctactttatcctgctatttcaattacaaaaaataataaaccttttagggcctatgattttccatataaatttcacaataagcttgttgatgttttcaaaatatcttgtttagattttgataggaattgcattatatctatagatggatttggagtgatttgaaatcttttactatattgagtcctctaatatataaacatggtgtaagtatcaccatttaggtcctcttttattggcattttgtaatttttagcacatacattgtattagtctgttctcaccctgctataaagatactaccagagactgggtaatttataaagaaaagaggtttaattgacttggtttcacatggctggggaggcctcaggaaacttacaatcatggtggaaggtgaagggaaagcaaggaccttcctcacgtggcgtcaggagagagaagagtgaggtgtgaaggggaaagatccccttattaagccatcagatctcgtgagaactcactcactatcatgagaacagcatgtgggaaactgcccccatgatctaatcacctcccgccaggtgcctccctagacacgtggggattatggggattatacagttcaagatgatatttgggtggagacacagccaaactatatcatacatcctgcacctgttttgttgagcttacccataaagtgtttcattttctttttggtgattgtaattggttttgtgttttaaattttggcttctgcatgattattgttggtatatagcaatgttatgaattttctagggtgatcttgtatttcaaaactttgctgaactcacatttatagtagttctggaaattctttatttgttggaattttctacatagacaatcatgacatctgaatttggagcagtttttttaatctttccaatatgtagtttttatttctttttccttactgcagtgactagaatttttagtagtatgttgaataagaaaggtaagagcagagattcttgctcttcttgttcctaatcttaggaagaaaaagagttcaactttcaccattaagtatgatgttagctgtagattgtttgggtaagtgttctttatcaaattaatgaagttcctctctattcctaatttcttggagttttgagtattaaatattgtcacaaggcattttctgattcaattgatatgattatatgatttttcttctttagtctattaatgtggttgattacactgattgattttcaattgttgaaccaaccttacatacctgaaataaatcctacttggtcatagtatacaattatagtatatgtagtatacaattccttttatatagtgctgaattgatttgctcttctttctctagtttcttgaggtagaaacttaatgttttaagatccttcctcttttctcatataagtattagatttagcttagtgttgtaatttaatgtgtaatttaatttagtatttaatttagtttagtgcaataaatttccccttccacgctgctttagcagcatctgacatattttattatgttgtatgtttgactcttggacaaaatgagggcttggggtattgactcccgatggagttaaaaatttgcatttaacttttgaccaccccaaaatgtaactactaatagcctactgttgaatggaagccttaccaataagataaatggtccattaacacatattttgcatgttatatgttttacgtgctgtattcttataattaaatagagaaagaaaacattgttaagataattataaggaagataaatatatatttactattcattaagtgggagtggatcattatataagtcttcatgctcattattttcacattgagtaggctgaggaggaggagaaagaagggttggccttgttgtctcaggtggcaaaggcagaagaaaatttgtatataagtgaatctgtgtagttcaaacctgtgttgttcaaaggtcagctatattttcatgtgcattcagttctatgtttttgaaatttcctttgaggttttcaaaattttcttttacaactttctttttgactcatgggttatatagagatgtattgtttagtttcaaataaattggagattttaaatattataattctgttattgatttcaaatttgaatcattttcaatcagagaacacattcagtgtgaattcagttctttaacatttgttcaggattttttaacaggccagaatgtagtctatcttggtgaaagtttcacaagtatttgaaattaatgtgtatagtttgttttgtgtttacacacgcacacaaacacagatgcatacacatataaatcttctgttatctttttatttctatttaaagaacttcttttagtcattatttaagagtaggtgtgaagaaaaccaattctcttataaatagaactaagtacatctactttgtatacttttcttgagtgattctatattgtaatgatgtcctttttactagttctatcaattgctgagagtttgctgttgacgtccctgatttaattgtgggcttatctatttctcctttcagctgtatcagtcttgcttcatgcatgttaaagttctgttgttaggtgcatacatgtttaggatcattaggtctttctagtggagatatcattttatcattatgtaatgtccctcttaacctctagatatttggtttgttctgaaatctatgctatttgatagttactagttattccttttttcttttgattaatgtttgcagatatatttttctgattactaatttcaactgacctgtgttgatgtccatgaagtgaatgttgtacagatagcatattttttggatacttttttaaaaattaagtttatattctaatacactctgctaatctctgtcatttatttgtatatttagaccatttacatctgagattcttactgatatgctagccttatgtgtgcaattttattttttctatttcttgtctgttgtgggtctctgcatttctcttttctgaccttgctgtaggttacgtgaacacattttaggattctatcttggtgttttaacagcattttgggtatatcttttttgtatagtgtttttagtggctctaggtattaaagtatatgtaagtcacttatctactgacatggacatattactacttccattaaagtgtacttttatttccacttaggtcctttactcattctaccttttcagtataattgtcttaagtgtttcccctacatacagtgagcatcacattacactgagttgtaatttttgcttcaaccgtgaaatattatctagcaaactaataagagggaaagtctaacttatttccccctaattttattcattctgatattcttattttctttataagttctgaagcttttattatcattttgtttctatttaaagaacttcctttagtcatcctttaagaatgggtttgatgaaaacaaatactcttatttttcactcatctgagagtgtcttgatttttccttcattccgaaaggatatttttgctggatataaaatttatgattgacagttaattgctttcattacttgataaatgttgtgccactccttctggcttctaatttttcagatgagaaatctgttgtcatttgaactggtatttacttataagttttacatcattcctctggctgctttcaaggttttctctttgcttgttttgtatttagcagtttaatagtgaaagccctagcatgagtttccttggttttatcctattgtatgagatttgctcagcttcttgcatgtgtttgttaatgtcttttgccatattttcagtattttcagacattctttcttgaatacattttcactgccattctctcctcttattctaggattccagttatacaaatgttaactcttttgtttttaactcactggttcttgaagctctcttcaagtttttttttttccttttaatctctcttttcttatttgttcaaattaggtaaattcttttgatttccttcaggttcaggaatcctgtcatcttcctgttacccttgaacccatatagcaagtttgagtttgtttcaatggttgtatgtttcagttatttagtttccgtttggatcttttatatatatatatatatatataacttctatttctatgctggggtttctctcattttttttcttgcttgaaagaattcacaattgcttgttgatgcatttttattgtatctggtttaaaatccttgcctgataattccaacatatgattcatatcactgatggcatctgttgatcttcttctttcattcaagttgttattttgatggttcttagtatgacaagtgatttttattatatcctggatgttttgggtatcgtagtatgagactctggatccaaattcatcttctttttttattcagaagctgtccttacattgaggtgtgcacagaggccaggtgggtgtgtatgttcattcatcaccccgttgtcactgccaacatcatccagcagaagtggagcactgactcacactgcagcagatgggtagggtgaaacttcagcttccctgttgaccccttcccagtgaaagcgggccgcctattgctgctgccttgttgcccctcatggtgacatattcctaactccccactgagccacggaagggaaaaattcattgcttgttcacactactttgttgctgcagggtaggggtggaagctgagcttcctgctggtctctgtgacaccaggggaggtggggaatggagtgtcaagtaaccctcctcctatcaccttattctgcctcattgatgccaggtgtgagagaaggttctgcttctctccagaactctcccagttcttgtgaactgggtccaattcacaagaaagggaaaaaggatgtagagtattgattggccctaacacctagcacacagtctcactaataccactgggagtaggggctcagctcccctctaggccctgctcacttagtgagggtggggtgggaacagaatggagactaaccctgacacacaccacctcatgtggtcttgtgctgtgaagagagtggagaggttcattccctccttggtcccactgacaccagaggttggagtaaagtaaagtgctgatgagccctgactctcgtgtccttgtttagtcttgttaatattgggtggatgttgagcttcagctcctgactggggccctgccagagccggggggaatgtaatgtgctgactagtcctgccttgcaccacttcactaagtcttgctgctaccaggtaggggtggtggagatggtttagctacttgctgggctgaggtgacactaacttagtaaagagttggagcatggctgactcctttcagacaggggatgaaagatcagccctctgctcactctgccaatactatttagaaaagagaatcagagtggcacaacttccactgagcagaggacagaaaataagctccttatttggtctcatcaaaaccacccctacctacagttagacagctgcctgtttcaacaagtggagaatggaagatcagctctctgtttggtttattggaaccaccaggcaaggggaattggaacactgactgcttctgccagtgggaatagaaggttagctgcctcttggccctgtcaacaccactgtgaaagggaatcaaaaactactgcttacttctgttgggtgagagggtggggtgaaagattagctccctgatgagctcggctgctggaactatgaatgtgtgtgagtgtgtgtggggagagagtgtgtgtgtgtgtatgggtgtgcttgtgtgtgtgtgtttggtttttccattggagtttggctaaagtatgacaggtactttttgctaaaaaggttttctcttgtaggccaacattttcctgatcttctgtctaggaaaataagcctttccttggagcttattttgtctgtgcctgttggtggttctacgttagatgtttctggatattaaaacaacaacgaaaactagggaatttgccatgttgttcctcaagtcctcagattcctaattttttttcttctacctacttcgcaaagtcatcttacacttatttgttttgttatgttcagggctttttaattatagaaagagaactgggaggaataaggctgctccatctctgtcaggatcagaagtcatgtagtgttataaaaaggactttgtctaccattttaaaatagctgttggctgtaagctccttattgtatttaaagtatattggctaaaattgtgggaggtaaggaaaactctttgtaaagtgaactgacatggtgaaaagagagagaagatatgcttgtcaaatattgcgaagtctattcagatcaagctagacatggtctgtattagtcagggttctccagaagaaaagaaccaataggaggtgcatgtctgtgtgtgtatgaaaaggaatgtattagggagaatttgctcacatcattataaaggcaatgtcccacgacaggctgtcagcaagctatagaatgatagaagccactagtatgtctcccaaggaaggtgatactatgtctcagtccaagtcccaaagcttcaaaaccagggaagctgacagtgcatcccatagtctaaggctgaaagcctgagaacccccagatcccccagagaccactgctgcaagtttcagggtccaaaggctaaagaacctagagtctgatgtctaaaggcaggaggaagaaagggcattctgcactggaagagaaagagagaggcagctcacaaagcaagaaaagcctgcaagctgaatatcccccttcttctgtctgctttactgtagacacacctgcagctgattggatggtacccacctacattgagggtaggtctttctctcagtccactggcttatatgtcaatctcctctggaaacaccgcaatagatacatcaagaaacagtgctttaccagccatctaggtatccctcaatccagtcaaattaatattaaccatcacatggcctattcacaatttaaaaatgtagcataaattgcagcagtggtcaagtgtattggcaagttgtaaagtgcctataagaaacctatacacgagcatttgcagattcccttaacacttttcagcaaatattttgttacaattgaaattaaaaggcagtttgaaattgttcctctactaaatatcacactggatatgaataaaataactagatagactaacaaggtacatactttattgcctgtgattattgcaactaccactcctggtggagagccattcttctcaggtgtgcaagtggaagattaattctcaatcaggaatatagatttgatacaaggaaagcatttcacttggcattagtgtgtcaacatttcagctaatttgcctaaccacaaatacttcagggggaagagaaattgctagtgctttatattaaacattggatggagctggcggagataatacaatttgtactttttttacatagtttcaacgaattttggcagatatgtctttttgaggcaactttagatgttgaaaagctgcttgtggatattcaagacttgtctttttttcatgttacaatgaccatcaccatagtttgtatctgattttttttgtgtgaattgaggaatgtggagtcataatgcaaaagtcattgccataattctttgcagatcttatgactggaaattcttgtgtatgtagtttgatattcatttgtaacacatgtaactggttcgtgtaatgattaaaataataagtaatgcttgatcatggttaaaataaataccaaggataaattcttctattaattagtgtaagcttatcctaattaacatctttaattatgggctgttgttaatttttgtcgcaacctattagatatactgtcctaaatcattaacactagtgtaactgagcataaactctaggtgactcacggctacagtggaagcgcccatggaaaatatatatttctaagtacacagtttagataatttcaagcagaatcagaaaattcttgatgaattctaaatttagtataaacagaaatgtattaggtttggttattgagccaagcttcaaacattgaatatcagaattgtgtccatttgcaatgagtaagcatttgattcaagatttttttttgtactcagactcatttttgtatatctttctgtttaagtcatattgtatttactgcgattacagattttttacatatttcttaaactggttctatgttatgccattatataacaggtgataaggaatgtactgtcactgccccttgacaatgaaaaggggacatctctactagtgtatgtgtatgtagctgtggaggagttgaaacagtgtaagtgaaatgcctagaaattgtcctgagttttgattttgtttgtgcttacatttttattagtatatgtactttcttgaatagataattgatttggggcaatatttctcaatcttggcactactgacattttggactggataattattggttgtgcctggctttcctgtgcattgtaggatgttcagaagaatctctggtctctacccactagatgccagtagcaaacctgccacctctctgcctacttccgtcctgtcttgcaatagtcaaaaatgtctgcagacattgccaagtgtcccctaaggggcatgagccttggtggagagaaacttctttacagtctcatccttggcgatgtcatttccttataatttgcgtagttaaacatttttgttttgaggagcataagttgtgataccatacctgtacagaagaggcttggatttaaggttaaccacatttaactgagagaattttatcaaagcatgaaataagaaaaataggggcaaaaaatgaaattctaaaatggcttatgcaatttctaagggtagctaataagaattctgaattggtgacattgtttttaaaaaaagtaaagcattaaaagaatttcaaagataaaatatattttttggagtgtgaacactgtaattaaggagacccaataatgttaagttacttaaaggatgtatttttacttaaagtaggatacaagttggagaaattaacattcggttgattgttaaatattttgattcaaagaaagaacatagaattgtcagcctcaaaaaatatgcttaagatagaaaaataattttggttgcatgaaaagaaaaagattttagtaaattgttgacttgaaaaggggaactatttgacagaagtctcaacagtgttttggagtggcatagtgattggggggtgacatcagatgattagagttaaaaacgactggaccggctgggcgcggtggctcacgcctgtaatcccagcactttgggaggccgaggcggctggatcacaaggtcaggagagcgagaccatcctggctaacacggtgaaaacccgtctctactaaaaatacaaaaaattagccgggcgtggtggcgggcgcctgtagtcccagctacttgggaggctgaggcaggagaatggcgtgaacccgggaggcggagcttgcagtgagcggagatcgcgccactgcactccagcctgggcgacagagcgagactctgtctcaaaaaaaaaaaaaaaagactggaccagttattaggccttaagttgatgtaaactatatgacaaattgacaatttagagacattgtggggacatttctatgaaacgtctgtttattattcattcctgtgatgattttgaaagggcaaataaaatcataatcacatattgtataatgctttttgtctttcaaatacatatacattaaaaatgacttatataaagcaaaatgtacctttttgtgcacaattctattggtttttgtggatgtatactgttgcataaccaccatccaaccaatacacagaagagttctataacttcagaatattcctttgtgctactcttttatagtcattcccatcttcccatccccaccctctattgacccgtaaactgttttctgaataaatatctgggaaaaggattgctgtgccacatggtaggtgtatgtttaaagtttctcagaagttgacagactttttccacggtggctgtaccattttgccttctcaccagcaaaatgtcagattacagttgttttgcatcctggccagcacttggtatggccacttcatttatttatttagctcttcttctgataggtgtttagtggtatctcattatggttttaatttacacttctctaatgattgatgattttccccggtgactgatgatgattgaggatcttttcaggtgcttatttgcctcccatgtgtgtatcctctttagtgaaatgtttgttcaaatcttcccatttcaaaaaatgttggcccttttcttattatgaaatttctatggctctttatgtcttgtgcatagaagtcctctgtcaaacagatgtctgttttgcaaatattttcctgatttgtagcttgtcttctcaatattttaacagtgtcatttatagatcagaagtttccaattcttcaggtctggctcccctccataatctgtttgctttgattcacttttcagcatcctcatgtagttgctttttgtgtttggtctgagattttacttgtgattggcagggagagataggctgaacgtgactgagtggagtatagcatgagaagacttgcataatattttttttaattttcagtgttttgcaaacattatttttgatccattaataatgttaatgattgccattttatatacgagaaaataaaaaaatcaagagtcataagagtttaagttcataaataataaaaagccacatggaaataaccagtgatctaaatcacctggaacaactaaaaccttaaggtattatatcctagtttgtgtgttccgaccacaagcccctagaatgcaaattacttatgtaccttatttaattatgtttgctttacgtaattttagtactttaggaacttccttgattaaatttcaattcatacatttgctgaaaaataactaattttaaaactaagtaaggttattaagtaacttttttccatctggaggagaattgtttttgttccagattctttactgacacaatagtagcacactcgaataagtgcatagtatgcttcatggaagatcatgtgtaaaagccaggcttagtcaatgtttcttctgataatacatgtgaaaagttgaaaagaacctttatggtcattttcctagtaagcaagtcaattccttttgcttaaagcattttaacttcattaatgtaaaagacaatagatatctactatgtatacaacactttttaagagatcttgaggttacagaagatagtaaagccatggtgtctatccttaagaagctatacataataagaaagaaagaaatctcactgtgatattgagtatacatttttggaaagtaatttttgaataaaatcagatgttttaaaaaatcgtaaaaggttttgaatcaacattttcaaatatttagaaaataaatgagaaaaaagacagacccaaccaattccttccagtaattttgctctgatattaatgtaattcccttcagcttttatgtgcatattatatatgttattaaccatagtacatctttaaaacatatataattttgtctgctcacttttttttaaaaaaacagcattgtatcacagtttattttcatgtaccttcatagttcaaggtacaagggaagtaacagagattccctgagagaagacaatggatgttcctaagaaagacctagtgtgagagttcagggaactgctacactttggattttttttttttttttttttttttttgagacggagtcttgctctgtcatccaggctggagtgcagtggcacgatctcagctcactgcaagctctgcctcttggggtcatgccattctcctgcctcagcctcccgggactacaggcgcctgccaccatgcccggctaatttgttttgtatttttagtagagacagggtttcaccgtgttagtcaggatggtcgggatttcctgaccttgtgatccacctgcctcagcttcccaaagtgctgggattacaggtgtgagccaccacacctggccaggattggttttttaaaataatgtagaatgttttgtatttgtccttgcatcatgtaaagatttatccttaaaagtgcaatttgtctttggactataaactctgcgagggacaggacagtacttacatagcatgttaaaaattcaagtatcaatctacccatttaggtctattggctctttactgagtccagggttttatttacatgtatcactgaatgaatggccttaagaaggtacagatgagactactgaggcatagagagatttaacagaggcaagcagagcatcacaagcagtttggaactcaacacatgtttcttgtttgaaaatatgcacagacaaaagagggatggatagaaagttggttcaatataggattaagacctggaacaaaagcacatgggcaccagcagaatctacttgagaggtcacagcgcccaaggggaaacaaccctaggcaagtcacttaacctcactcaccttagttctcttgttggtaaaatgcagagtttatgcaaactcaatacatgtcaagaaatatctgcaaggcattgtttaaaattgaccctctggatttttttcatgcatgcctggttattatttattaagatgtactaggggcaagtctcaaatggaagaaaaaataaaaggcacatctgcaaagtgaagaagtggggttaagcgcaatgcaacagaaactcttatactaatccaggaggactttacctgtcaatcaaatctatattcattttttttaaagattaataatggtttgttaactgagtaagctggcagatggtaaagtaatgtgatgagatcttggggcatctatgaccagttgatgactgactgaccaatttcaaaagatgctatgaaggatcataaagtttagttccatgtggattttgatgatagttgcatctatatttaaagccttctgtcactggaagcactcttggtgttgtcagactgtctattggactggatgagctgcaacttctcgcaattgaatgtcaataagaccaaagcaattttggttgattcatagcaccagcttaagcatattcacttgcacagattacatttgacagatagttaccttcagctgaactctgtggttagaggcttgggcgtattcttgacagtgagcttagagttgatgtctaatgtttatttcatatcctgtttttaccttccctaatattgcatgtgtaaatctatatttaaatatattcacagctgatgttcttgtcggtccacttgttatctctggacagaatgctgtaatgattcaatttaattattttaataaaaataacttgcacccctccagttttaatttcaataaatctgacgagtaatgattaattttaaggagtcttattgatgagcaattgcaacactataatgcaggaaaatgcccaagtggtgggagcatgcttacatctatagtaaacttaaaaccttcaaaatttggtgtgtgattatgaacaccgaggaaatatatccacatttatttaccaaattattattcctgtatcttttttaagttatttaggtccatcagttatcttcaaagtttaggtttgaaactatccatttcaagaatattagccttttaagatgattataatttaaataacatattctaaaatgttttaattgaacagtagaatgcatgtaacccaaaacattataaaatttaaaaagtcacggccatttttgaatatttagattgggaaaacacttaagatgtggttttatgttcaagaagaggtgcaattatggtatggattcattcatcattatggtattgtattgtcaacttttcagttatgttcaatttttaagatgctgggtgggaaatttaagggacatatagatctaataatctgagcctaaatctcctgctctatacaaataactctgcaaagctttggaatccctttatttgactaggtgaatggcagttttgtttgcatcagcctaaacctagcttggaaatcatgattttaaagcaaacacgttttcctcacacatttccatatttcctagaatctatggttttaagatatcaaacaattcaaattatgtagttatacatttcacacaggacaaaaactcatgctgaagtaggtaaaatatttttcaaaattattttctctacatttactggcatactttctctttcttactgtcttttaaaactgacagtcagttttttttatttttctcttttactgacagctagtaaatgtactgacagttcagaagcaagatgtaaatgtaagtcactattattttgttcacctgatacctgagcattagtagaaatgcatggctatattttaaaataaaaactagattatttccaatggttctgaagggaagatgtatagaaaaactgtcctctgtaaataaaaatgtgtttgaggcaagattgcattacatttagaaatagcatactttcctcattaggatgtgattggtatttgtactgaagaaaatgggctaattatttaagtaagatgtatatttactttctgtttcattagctgtaaatctttatagcatataaatctcctttagaaattaatgggaagtatataagtgagggaaagaaagcaggttatgaagttaataaataccatgttaaaaattagtttctacttaaatataaagttcaagattaaaaattaaaaattgttttattttaattagaaaaatcttgcttagttaatttctctggaagaaatgctatataagcagttaaatgtggagaattatattctattgataaaagtatgttgggccagactgaaccaacaacatcatagaaggactgattccttacttcctttaaaaagtgatctgtcatttgtctacattataaataacagctgagttttaaaacacaaggagatttttaaaaagtggcagcatttatttatttactgcttagacagtattcacagtattttatttcatccttaagactctttttttgttttgctcccacattattgttacacatatgggaattggtaaagtgggaaaacttagcatttatagatttttatactgaagcatgcgatgataaagtagtcactttcatccaagaaccttttcctcttttcacttacactagctcttccagaaatggcccctttagtgcctttaatggttttattctccttctgtcactatttttaatattcttattcttatactgccatcatatataactttgtgaaaatttgtcatataaggttaaaattgatttgcctttaaatacagtagtttccattttctgttaactgtttgaagaacacctattgagaggcaaggaaagacctgcgggataagttacaaaaggcaagaattcctcacagaaaaagcagcaggagcttccttgtcaagagcttcagcaagtagtgtcagcagcttagaagttgctattggactgctgagtgttatgcagataaattgtggctctagcttgtcctccgatgtcattctttgatttttctctgttaacactgcatttgcatttgggtctcactgagaacaaggaccagtgcaaatgccttatggcatgtgtagaaagctgcttttatgttaaaagtgatatgttttcttgttcactgtgttcacaacaaaaattcatcttccgagtcttggaattcccttatgtatttgtaattttccttccaagtcataatattcatatacaaagagtggaaatttttctttaaaaaaacctaccaaacaacaaaaacagtaaagttagttggttactagcagcaacaactgaaaagcagcatcaccaaaacatatgcaattcatgggtttccagcaaaagaggaaatctggaaagagaagatccttaagtattgctttaaagtgagcactgaaggacagccgttaaaacaatcccaatttttagaaaaggtattattccctgacatttacttgttttattcccttctcaatctgaagacacattttggacagatgctcttgtcttacatgaacattcaattcatttgagaaaataatggttatacttaaactcgtgaagtgaaatgtatggaagtctgttgctttataactttaaatagccatgtaacttgttcatggcagaatatagtcaagtcctgggcaaggactttttttctcttctccaataatgctattcaaggggaagctagttattgtgtgacacatgcttgattctcaggaggtttggacaaaagagagggttagaaggtcaggagagcctgacgctattcaactagatatttgagtagaattcccacaccagaattttgcctcatacctaattcagacagtgtaataatgggggaagggcagagagagggagggcagatggaggtgtcctttcaggttaaatgttaaaataagggtcttcatttctgtctctggtggcacagagcattaaaaaccctgtgacacattttggaagtgttgctataaaatagattttaacgtttgaggatctataaagggtattattgagtacttaatagattctgtgtttgcctactgaaatcactacaccgccgatatatacctcattaatttgtaaagcagtttggcccaacttgagacaatgtactgtattaaagcaaagtctatatcccaaattttcatggctaataattacaaaacgttcagcatctgaagaaaattatctaaatgtgacaatattggtcttggatagtttaacttgcgtgaaatatttcacacagaaacatttgatctatattgaagagttgtttcttttttcatcagatcagctatatcacagtaaattgtggaaatagaaaatggaaactaaattgttgaaaatgcatctgatagtttgtttttattgccaaaatgtcattgtccttgaggtccatcactttgtagcttagtaaaaacagatttaggcattgcaagtgagaagtcattgactgttttccttgtaaccaatttatttatcaagttggtaagtttcagaagtatttccagtgttcagcctatttcttcacttttctattttccaaattatatcctattacttcaaagatgtataaagttcacacattctggattctttatctcttttattgttttctgcttcatacaaagtaattaaattatgttcttgaagtaattcctcctatcttacttaaaatcaccttcatgatctgtcaagagttttcaagttgttctgtgataaagttcttagagtttgagaagctaaatggtggagttggtgcttaagctcttcactgaaagctgcaagagtataaacgaagtcagaaattactattattattatttttttctcattgagacggagtctcactctgtcgcccaggctggattgcagtggcgtgatctcagctcacggcaagctccgcctcccgggttcgctccattatcctgcctcagcctcccgagtggctgggactacaggtgcccgtcaccacgccaggctaattttttgtatttttagtagagacggggtttcactgtgttagccaggatggtctcgatctcctgaccttgtgatctgcctacctcagcctcccaaagtcccaaagtgctgagattacaggcatgagacaccacacccagcatatatatatatatatatatatatagttttttggtttttgttttttgtttgtttgtttgtttgtttgtttgtttgtttttttgagacgagtctcgctctgtcgcccaggctggagtgcagtggcaggatctcggctcactgcaagctctgcctcccgggttcatgcctcagcctcccgagtagcttggactacaggcgcccgccaccacgaccagcaaattttttgtatttttagtagagatggggtttcaccgtgttagccaggatggtctcaatctcctgaccttgtgatccgcctgccttagcctcccaaagtgctgggattacaggcatgagccactgcacccggcctgaaatgactattctttttaataacttctatttattgttttgtgttattcataattgttgtgcaatttaatttatttcactagtagaacactatgtacaggactgtactgtgtggaggttttagaagtgacaaaaccagttaactaggctcttggtccaaaggaatttagtgaaagagataagacataaacactaatgactgtaacatttatggaataataaataggagctgctgaaagttgtgatttcttctcattatgatagtgcttcttggattataaaaaatttaacctagaacatgaggtttcaagaggcagagatggggagagaagaattccaggtttgggactaggatgtagaaaggcagaaaggtgaaaatattcttgtgatgatggcaaacagtgactggtcaagtttgccaagagtaggttttatgcaagagcgtagtaagatgaaaccctgaaggaattttactgtcagatgatagaaaccggaataaagctgaggatacagttcaataatcaaagggaaccaaatgaaagttttgagcaaagaagggatcttattaaaacagccttttattatttcttttaagctagaggtagcttggcattatctgtgccagctcagagtgaccttcaccccaaaattctagttggattatggagcagttaatcttacaggctctaataattctgtcaccctttgttgtcattctatatctgtgtcccttcagttatgtgtcttctcccatattctcataccattatttctctgtctttcatttctttactttcatcatccacatcaggacaatgtttttattctatagtagtttgtaaacatgtcacattctttagactttcaagctctttgtcaacagtttttcaaagtccttgccttacataaacactaattctttccctttagggacccctttcctggcccttccaagcaaagggtgctcattcatccactcctcatgcacctcattgctgggagcaagtagagatgtagggattgctttcttctttttcttttacctcatattggaaagagatgtttcctttaaagctcatgttaagttgttgtgtacctttcttcaatttttgcatcaatttttgcaaaccttgcatcaatttttgcagctgctgacaccttggataccccagccacctgcctgccagatacaatgaaaaatttcacctctgactcacagtgtttctctgcatcattatcagcttttggttaatgaccatgaagcttcactttttcacctcttgaaaacttttggctacagaatgaagttaagcgcctaggtgcttatattgtctttgagtctgttgggttccttctaggttcagtttcttcacttctagcctagcccacaaggaaaatatctttagtagtcttttaaccattttcttttatttcattttttttcattctgttgccaccagacacctattctcaaatcattcacctgactgccttcttaattcctgtgtatagattgcagaatattactgaaaaaaaacaggtgtgtggattgaggccactaaaaattaatgatttccaactagagatggacccttagtgcagccttagggtaaatttcagaggtgcagctgattcaaagggtgtgcacaatttcaggggtatattgacctactgtcttcagaaaatgtttgactagtgcagactcctaccgaaagagaatcagagtgcctattcctcaaattattgttaatataaggaattatcttttctcatttttttctaattttatgggcaaaatagtatgagtgtattcttatttcatttagcatttcttcccctacctcgtacttatcttaccttacataggcttattagccagccacatgtattttttgcttctgggtaatagctgtgtattgttctcttatttttttaaataaaggggtctgcatttttattaatgactaagaaatcttgatatatttagaaattatatgtaaaaataattttaaattttttttattctactttaagttctggggtacacatgcagaacttgcaggtttatgtcatagttataaaaaaagaaagaaagcataggcagagaaggaaaatcactctggacagaaaaaaataattggttaaaatattaaagaataaaatttgtaggtaaaaataataaattttaaaatgacagtttaaaaatttatatgtaggctgggtgtggtgccccatgccgatagtcccagcactttgggaggcctacgcaggaggatcacttgagtccaggatttcaaggccaggttgggcaacatagcaagacgtcatctctacaaaaaaaaaaaaaaagaaagaaagaaagaaagaaaaaaaattagccaggcatggtggtgcatgcctgtagtcccagctactcagaaggctaagatgggaagatcttctgagcctgggaggtcaaggctgtgagccatggtcgtgccactgcactccagcctaggcaacagagccagatcctctcgcaaaacaaacaaacaaacaaattacatgtgaaaagaattatacgtgaagataataatttcagacatacaatcctatgttaactcccatagaaaattaagggagttatcacacctttgcttttaacaattctttctcttcccacattccagttttgttgaaataagcagagcttcttatcccagcttattgtagcaaaatcattatagtaaaatgatatttttatttcaagcattacaatagcactttataacttatttaaaaatttatatgatgttaaaaggattcaatactcattgagtatcctttcataacatacatctctaatttcttaatttgaattgagctttctatttggtgagagtatttctattctgaaaaggaacatggccagtgatgtaccttctgaatctttgcgtagttgagcctgtctttctaatgcctgtacccatgaacaatgtctggatgatgatggatttttttttcttataccctttcgtttgtgagcttttaatacattgcatcgtgtttctgaagagaaatctgagacaagcttaaggattatttttcactgtgggtgacccgtttttgtgtgcctgagtgagattcttacaggtttctttctttatccttaaaatcccaggactaccagcctatagtttggtgttaattaatctttgttttcttgagaatatggtaagcttttcttagctgaatattcaggtcatatttttaatcccttaattttggtttctatcatgtctttgagtttatattttcattatttgttttcttcgggctttcatcctgtgaaatttagtgaccaatatagttttattccttttatgtccaagatacataagaagttgtatgtactctagtgtccattcgttcatcaacttattccaattaccccaaacccctatttccaagggcttttcttcttccgttcagactctttatttgggtcttttcgtggttccttgcttaacactatgcacttttcacggcacacactttccctgggaattcttactcacaaccatgactcctagtactattttcatatgcatagttataaaacctgtaatttctaaatttatattgccacagtgctatcagtgagctttcaaaattcaaattcaagtatgatttttcttagttttaagatttcttcagttggaatggagacccttaatgacttagctctgacaactgttcagcctcatgttctgtaaggtctcctctgggacctcacattctagtaacactgagctgtctagtctttaattgtatccatctttcttatgttgctacaactgcacatgttctttaccaagaatactctcccttactatttattccgcttaatcctactttttcctttcactcatttggcatcaacattttcaggaagccttttcttatctcaaaatctgagtagacatgcactcatcctttctatgaaattatcgcaatttactcaatgtgctttatttgtgtccatcactagactccagaacttttagatcaagaattttaccttatttagtgttgttcccttcagggctcggcatcatgtttgaatgtgatccattctcaataaacaaagtttgattgaatgagtgatggcatcatccagtattagaacaaagttgataggacagtttgtttagaagctcttgcaagaatacagttgacccatgaactacaaggaattgaattgcccaggtctgcttttatgtgaattttttcgagctaaacacagattgaaaatacagtacttgcaggatgtaaaatccgactatgcacagggccgactttttgtatccctgggctccgcaaggctaactgcgagacttgggtatgattagattttggttatttatgcctggatcctggaaccaatcccttgaagactgtacagatgagagatattagttgatcgaatatgtagcaggagaaaactgaaaaaggaaaagaaatttatgaagtaaattaatgagaccgctgcatttcattactactttggagattagaggaacaataaaggtgactttaaaattttgaaccaacttctttataacatggcttacaagtggtagctagaaagaggagggttggttacttttgctttgtatattgcaatacatttctgattgttccctttccacttttccccctagtattgttgattactttgtctttgtaaaaaacttcatcgtgaaaatttctttctaaaatgtaaatgtgattacctccttcctctccttaaataaacactatgctcacgattgctcacactccagagaatgaaatttccttcccttagcaacatgttcaagatccttcaaaatttgttagatggtgcctctatagcttcattgtccttctatgtactttgagttttaaccatgatatttttttgcctcccaaaatcatgtactttgtggttttcatgcaagctcttcctgtttgccttattcagttgcttctagcttgtacacttttccctctccctcttcaactccatttctttgtgtacgtatctcaatgaccaccacaaatacaacttcctctgtaaaacacactaatttcttctctccttttctcctctctgctcctatagcacttttttttcttattggctgtatgacatttattacataggcatattttattagatattaagtaggttttgcattaggtatatttttgaatgtactgaaaggcagatactttattcattcatatgtgctcagaagagcaaaatatctcttacataatgtatgtttaatataagtaaatatacaaacaaatagaaatattgagtttggtaaaagatgatattgagaaaaagtgatatgtgatagaatgaaaagctacatatattttctaaatgatgggtggacatttacaactttgctaaattatatattaaatcatctctttatcctgaaaaaattatcttttccatgattagtaagtactttacagtctcttctaggttataaagctcagtactctaattagttttagaaaaactgtgactaaactagcagtactgttttttctcccatattttgtctcacactgaagtcagtgatatttttttctgttcacagatatattcactcttagccttccctgagctctattacagcctggaaaataactggaatttcctttaaaataatacacattttcttaacttatcatattaaatgaaaaacacacaaacactggcctcctttcacattccctagaactttttgttttttctgtatttggcatttctgatgtctttaattttttgtgattctggctctgtattctggtgcctggaacagtgttgcttccaaataaataggcagtagtgatagcaatactcataaatattttaagctatttggaaaaagatattttttagaagctgtgttttgaatgaccttcccatttaactacagtgaatttcattcttagttccttcccaatatctaccctcttgcatcttcttttatgttgtttctaacgtcttttgcggtacctatcaatttactgtcatctactgttttcattaagattgctacttgtagatcattaataaaaaggtgaaataaaactaaattccttatcaattctctccttaagtcaataagtatccagttttaaatgacagtgcttgaattcaagttcatattaaatgttacttcaaataagtttgggagtttacacatacatggctctttggttcaattacatttgtcttatttattttgttttctgttcccttgtagtattctttgataaacttgtcctttaaaatatatattccaactaaactctgcttagggcctaagtggtgtagccctctggggagggtcgcaaatgtaatttgtttgattggatactcaagcttttcaattgttttcttttccttagagaaatagaacctttctagctttcaggtcaattgatgtaatggttggattcagatggaatgacactttctccccattgtaagtctctagttcctcagagaaatccttgggaaatctgttgacaacttgctgtcatccagctgttctgatggtataaatgacttagacactgattcctggtagtttaaaagtctaatggaacagtgaaattttgagatctcaagtgcatcatgaataaagcacttaagtagcacttgtatatacttcttacaatttgttaactggttttctgctttttttttttgctggagaaagagatttacagttttaatctgattagacattagcagctggttgaagatgctattactgtgaagtatggaaaagaacacaatcatgatgaaaactttttactcaaatccttagaagaagaaagcagatgaaattagattggcaaaggaaaccagcccaaattacacacaggagagaaatgtagcagaggagagtactgagttggtgctgcacgcatagagcttacagcctccatgggcaggggacatgtgggtgtgactgccagggacaggaattgcaaacagcatttggagtgacagtctgggtcagcttctcatgctctttcccatcaccaggcatcagcgagtggaaagatttgacctgattttggagcacagagtgtgggctctaaggccacaggaaggcaggtgaatgggactaggatgtagtggagtccccatggctaaaaaataagttgtattgcatacctgcctttgccccacaattatcaaatccaatctagggtgaatagaaacacatctgcagacagatccaatgtccacctacaaaaagtttcagaaaatgaaaacagatggagaaaaaaaattataaaaatataaagaattctggtaaagttgccaaaagaaatgagtcttctagtcaaatgggctttgttctattagtagatgttgagacgaatgcagtgaattgattagagctgatgttatttgtttgggtgcatacatgtgtgcctggtgaggggtgggtgagggaagaaaaaaaactcaaacaaataagaaacatattgagagaaaaataatacctagagaattaaaatagtacactataacaaagtttgtgagtgattattaaggcttgtgtgggtattcgggggctctctgaggtgtcaatatgtaaactgagatctgacagtaaagactcagctaccttatatctcttcatccctacatcttgttctaagaaaacatcagaagtcctgtgatctcagcataagttgaaaactcgtaagtagtcattcaaaggtggatttgtggagggtagaggtaaactaccttgattatatttacatagaatggaagtgatgctaatttagaaatgtccattgctgtaagtcttaggagatgtaaagtaccaatgaaagatcctgaacagtattatgtgacagaaaatgagcgttacacttttaaaaaaatattagatgttgtaactttagtcattctcacctttaccttttaagtatttcaccatttaatatcaaccttcattattgatttatttctaaagatatctggaaatagtttaggctcattaattttctttttaagagtcaaatcggcatgcaaatgtttctcccaccaagaaatttttttcctggacttcaccttctgaggcatgtccacctttgaggcaagctaagccaggctttgtgaaggcagaaccatccgaagcacacagccccaccaaatttctctccctccttccctccctcccctgttcctctctccttctctttcttttttctctttctttctctttctttctctttctttcttccttccttcctttctttctttccttctttctttctttctttctttctttctttctttctttctttctttctttctttctttctttttatttctttccttctctttctttctttttatttctttccttctctttctttctttcttttttttttctttctctttcttctctcttcccccctcccctgctctcccctgctctcccctccccttccctttctttcagctgctgcttacctggggtaacatggtttgggaagaaacatgtcagaattggagtgaataaatataaatgataaaaagacaaaatgaatattattttcaagagtaattaccagtatgaagttcttcagatgataacaaaaactattgacttattttgtctaaatcaatgccactatcttatctgtgtgattgtgaagggaggaaaggaaactgttcactgaatattctgcatttgacccgtaaatacctacttttgtattcagggatgatatattcttaccttaaattaatgactgttttctactgttcttttttggtgcaaacaaattaaatgtgtgcacttctccatgactgattgtgcaaaaactgcttagacaattactatctctctagcttttgatcagaaaggactaccttgaaacaatggccacaataatggtattattctcaattctagaatttatttaaacaaacaattcaaatcatatttcataatacagttctctgaaggagcttaaagagattcagatttttccttttgtttaacatggctcttcatttagtttttgaggcatatttttaataaattttgctcagtactgtctactggagctgaaaaaatctaagaagacacaaaatggctgaagcataggtacttacagaaaagcatgcctttcttttaagaatataaaattaatacattatttatttattatataatgggatgttctacccttgttgaagattttagcagatataactcatgcacagtgtaagtgagcattcacccctgttttgtttatatggcaggactatttctacaaattttacaaattactgtttaggatctttatgacatccattgagtgctggcatgataaatgattttctatatatctgtctacatattgagggcctgattgatggcccttctgacttggggtcagcagtgagttcacatctcttggtatactttggcttattccctggaagtataaacagaaatccaatgaccactattttcattattttccttcaggcataatctgacctaatgatatgtaactgtattactgtgatttaagagatttttaaaaaactataaacattttgaggaaaagtgaaaatggtgattttaaatttaacacatttaaatattcattttatgaaaagaatatttgaaagaatagggatttatcaggatcaatagaaggcttggagtaacctaatcattttaaattttattccttcttgtttttttctgttttcccacaacttattcactaccctctatattctcatactttgctaaatcatattaatccttcaagagttggtttagatgaagcttcattcatttgataaagattaaatgagtgtccagtagttgctagctcaccttgttctgttgtgcttcacagacaatgtgttttatttttatttttattttatttttttacaaagtgaaggtttatggcaaccttgcttcaggcaaacatgtcatatattagtgctatttttccaacagcatgtgctcgttttgtgtatgcttcacattttggcaattctcacagaaatttaaatttttttccaatcattatagctgttatggtggtctgtgatcagtgatttttgatgttattataatttcagggggtgccatgaaccacaccaatatgatatggcaaagttaaccaataaatgttgtgtgtgttatgacttctccaccgacagaatgttcttctgacttgttccttctccttgggcctccctgttccctgagacacaacaatattgaaattaaattagaccgagtaataaccctacagtggcctctcagtgttcaagtgaaaggaagagtaacatttctctcacttgaaatcaaaagctagaaatgagtaagcttagtgaggaaggcatgtagaaagttgacaggttgaaagctagtcctcttgcaccaaacagccaagttgaatgcaaaggaaaatttcttgagggaaaattaaagtgctactctaatgaccacaaaaatgataaaaactgaaacagctttattgctgatgtggagaaaatttgagtggtctggatagaagatcagaccagctacaatattctcttaaaccaaagtctaatccagacaaggccctaactattccattatgtgaaggctgagagaagtgagcaagctacaaaagaaaagttggaagctagcagagattggttcacaaggtttaaggaaagaagtagtttccataacataaaagtgcaaggttgaaagagcaagtgctgttgtagaagttgcaagttatccagaagatctagataagatcactgatgaaggtggctacactaaacaacataatttcaatgtggatgaaaaagtcttctgttggaagaagatgccacctaggactttcatagctagagaagagaaatcaatgcctagtttcaaagctccaaaaataagactgagtctcttgttaggggctaatgcagttggggactttactgcacaggtggtaggtgccctaacccccatattgttaaagggtcaatggtttatagaaataatatagaagtaagtgtgtgattctatctaatctatctatctagtagtatctgtctatattcatattccctatatatccatagtccctacagccatccactgaggggagagagtgggcctgggagtagtaacactgaaatagcacgaatctacttagcaccgaatctttgttcctaaagaccactcatctcttagaggaaccaggattccttggagaaatggctgattccagggctgtggtggggaagtacaaaatgagcctagaacatcttgtgtcataaagtaagaagatacttaaagaattattagaacatgtcaatatgatccagaatgcagctgtatggggtctatactgtccaaacctggaacaacttgagcactgaaatacatattgagagtaattaattatatcccactgagtaaaatagagactcatgagtctatatagataaaaataagcctaagcatatattgaatttttaataagcaataggatatttatacagtcttgaagtatctgctcgcaaaatgtttgctaattgcaaaggggaaaattgtatttttacagtgtggaagcctggcagatatattaatgcaaatgattaaagttaacatcattaataatggaacaaatagaaatgatgtaagacatgataagatataatatgatcactgtatcacctgaatttaatcatgaggaaaaattagacaaacccaaattgagaggcaatctacaaaataactgggcggtcctctttaacagtattaagatcagaaaagccaaggaaagattgaagaactctttttttttttgggtcggcactgcttttttattttattttattattattatactttaagttttagggtacatgtgcacaatgtgcaggcttgttacatatgtatacacgtgccatgttggtgtgctgcacccatcaactcatgatttagcattaggtatatctctcaatgctatccctcccccctccccccaccccacaaaagtccccagtgtgtgatgttccccttcctgtgtccatgcgttctcattgttcaattcccacctatgagtgagaacatgcagtgtttggttttttgtccttgcgatagtttgctgagaatgatggtttccagtttcatccacgttcctacaaaggacatgaactcatcagtttttatggctgcatagtattccatggtgtatatgtgccacattttcttaatccagtctatcggtgttggacatttgggttggttctaaatctttgctattgtgaatagggccgcaataaacatacgtgtctctttcagatcaaaagaaaacttagagtcatgacaactaaaggcaacatgtgatttggggctggaggtgttttttctataaaagactttttggggtcattgacaaaacttgaatgggctttaaagataaaatggtaatgatatacgaataactttgatgtttacatcgtgcttatgtaaaagaatgtctttttgtagcaaatacacgttgcggtattcagggggaatgggtcattaggtcaaaaatttaatctcaaatgggtcagaaaaaattctttgtactactcttgtgactttcctgtaacgttgagatagttattttttaaagtaataaaaaacagaaactactgattgagctgcattacagatagaatgggaaaagagaaaatggacagaggaagtacaaacaacttacttgaggaacacctcaatagagagaagaagagtaacagggaaatatttggtggaggagacttccaagatattttcacgttctcatctttgttcctaaccactttattcatatttatttattatattgcctcctttcattgaaagtattttatacgccatttctattacagattgtaaattccttgaagaaaaggtctgtgctttatataccccttatgtgtagtatatgtagcatcacacttagcatatcataatgtgcttgtttcatattcaaacaacaggaccattttcaaacaagtgattggattttagtgagagtatgaagagcagttttctttataaacatgggagacaaaagaggttgactcacttttaaggagaggacattgtagttataacaagtaacttctagctcattgggatgtaacatgctgaaaaagttttctaaggtattttacagctaacttgataatcttttggaaatcatctgttctccatgagtaaaatagaaaaaggcacaatgatatattgaaataattaagagtatctaatattgtgatgaagtgtgcaccaaaagctttcttaaatgtagaagtgtacatgacacctctttaagcagtatctacaaaaaaccagctggaactctccctattccttaggaattcaataaatcagactgttggcagattttccatcatgtatatgtgtaaattaatagcttttttttggcagtagagagaagagagtaatctaaatgtgtaggaagaagaggccatgagagtttcacatccagtcaagataggacaaaaaaaaatctacttgcattcctatgttaaatttttaaagatcaattaaatggagacttgtttggtggaggttgcagtatatgaagagctttaatagagatgaggggagaacagcaaatccagagaatcatacccagggcacaaatgtaatacacgtaggctttttctgtagattgcttcaagagcctggcttggcttgtctgagttactcagagaggaaaaaatgaaagtgagtgtatatgttggtttggggtgtgtgaaggtgtgggaatggagagaagtggacagagggaaaatgtgttgaaataaaacaccaggagctcatggaaaatgcaaaacagaaacaaaaccaagaaaaaatctttgaggggcatacctgtgtatgaattcatttttccatagcacctttaacatagtcaaaacaaataaaatttaagcagttattcagtcaaactagtagcaggtgcacacacacattccaaacattacaaatatttgtgggccacccacctggttaatttctgccaaagcaactatccctgaataatttcctcaagtacttattcatattgtttgtataaacgtcactcaatagagaatatttaataaactggagcatttataattatataaaaattcatgtcagtaaacaaggccactctgaaaagttatgtgaagaatcacagtatgacacattttgttagaaaacggtgccttttctttattgcttagagttgtaacatcacatagttcatgttgttgttttcattttcggggtatcaattagttgatcaatcagttagtgtttattaagcttctgtccagcaggtaaagcatgctcatcaaatttgcaaatgacataaatgttagagggatggtaaaggcactgcatgacagacatagcatccaaaaagattttgacagctcggagcaataggctgaatctaacaagatgaaatataacatagataaatataaatgcctacctttgggtccacaaagccaactgtacatgtatagcattgagtagatgtgaattagctgttgatgtaagcaggaaaaaaaagacagtattttagttaatagtcagctcaacttaatttatcagttttagctgcatgatgtcattgccaaaaatctagcctgcaattttgaattgtattaaggtgacaatcctgtaccagtttgacaggtcagaccacatctagagattgtagtatttctggagccacattttaagaagagagacactaaaaactatgtcatatttagaacatcacagaaactaaacacatttatcctgaagaagacttaggagaggaatgacatccttctttacatttatgtaagctctcacatggaaaagggattaaatttgtttggtgcagtctcaataattagaactggaacttgtgaactgaagttataaggagatacctttgggttcaatcatttataataattacatataatagtaaaagctgttcagagagaaaggcgttcccaaaatctgcagaggcagaatactagcacagtttagcctgagtgtcctcctttgcaaagtggggacaacaccattgtgaagcagcgatctgggaaggcagtgggatgatatagggaaaatgttcagcacaatgaggggcatgtagtaagtaagtggttatagtacacaggggatgtcacctttcctattgtgggaggtggtgacaccaatcctgaatcatcactgggtagaggtatagaagagatgctaaatggatggatttgacaaactgactgttacttcaaaaccctaactgactgcaacttattaattaaatttgccatttaaaactgtctctgaaaccaccagtcacgcttctatagcaccttgagtatttttttttttttttttttttttttgagacagagtctggctctgttccccaagctggagtgcagtggcgcgatctcggctcaccacaacctccgcctcccgggtttagcaactctctgcttcagcctcccgagtagcccggattacaggctcgtgccaccatacccagctaatttttgtatttttagcagggacagggtttcaccatcttggccaggctggttttgaactctttacctctttacctacctcgtgatccacttacctctgcctcccaaactgctaggaatacaggcgtgagccaccgcaccaagctattctttttttcttttttttctttttttggatagagtctcactctgtcgcccaggctggagtgcagtggcgtgatgtcggctcaccgcaacctccacctccccggttcaagtaattatcctgcctcagcctcccaagtagctgtaattacaggaatgcaccaccacaactggctaatttttttgtatttttagtagagacggagtttcgccatgttggccaggctggtctagaacttttcacctcaagtgatccgcccacctcggcctcccaaagtgctgggattacaggcacgcgccattgtgcctggccaaatttttgttttcaatcctctgtgcttatttttaattatctttaaaatggagaaaaaggtaaacctgccttaggtaactgtaaagttaaaaagaatgaatatgcataaatattttagaacaatgtctgacatactttttttttttttttttttttggcagagtctcactctgtcacccaggctgtagtgcaatggcgccatcttggctcactgcaacctctgcctcccgggttcaaaagattctcccgcctcagcctcccgagtagctgggactacaggtgtgtgccaccacacccagctaatttttgtatatatatatattttttaagtacagacggggtttcactatgttggccaggctggtctcaaactcctgacctcatgatctgcctgcctcagcctcccaaagttctaggattagaggtgtgagcctccatgcccggcccatactagctttttaatatatgttaactacttttgtaatgccaaagtaggtggcaaaggattattggagaagagaggacttgagatgtgtgttttgaaaaatactaaaaatttagttaagtgcctatatggaaatagcttgaacacatcatgagattaagtggtgtgtgatcgtcagacagtgaggagactttaccagttagattggaggtcggctgttggtgaaggttagaaataaattgggtgagatgagtgaggaaaaatctcagaaggccttaggtttaggatggtaagcaataggatgggatgtgtggggattccacgtgttcgtaggtaggggaatacaacatacatgtgatttttaaaataaacttatagagttttcaggatacattgccttactttagcttaaaaattatggatggaatagtggaatctttttatgcaaatccttctttcacttagaaatagaaatttctatttcagggcaatttctatttcagaaagtccaagacttttctcctccataaagttttctcttctgattcatattacagtggttttctttttgtttgaatttcttagcattcaaaatgatgttccttatatttgtatcatccatcatgatcttttaaggggaaatttaaatttaagatacgttgtcaaatcgcttaatgttaatctattagaaaggtgttattctgaatgcataaaatggttttgctttaaatgaggccctccaaattaataaaactgctcttcctgggaagcttctaagttggttctgggaaagcaagtcacacagagaaggtccaaaaatacgttatacaccacatatattaacaaattaagacataatttctcaaagcaactccttggaaaagataatccttcttgactgcattaagattcagtatttaagttagaaacaaccatcatcatttatagtgattcaaacactatctagcatattaaaatgtattttgttgtcatcatacatacaagctccttgagagaaaggatcatgacttaactcttgttggtgtagctcatagggccactgtgggtaccgagttgatgctttatgaattcagtttaaattagaagaatgtaggcaatgggattaccatttgtccagtaacaaattcagcacaggtattctgtctctctatttcccagcctgagtcagcagtttcttttagttctgatggccagcaggagtaaaatagcagcaaagatctggcatttcagtggcacaggtgattgtggaaaattactataatctaggtggactcgattctattttccccttgctaggtactgagatattgtgtaactttctggacttttgaattatacttctcactaatctagcatgagaatgggtggatagtgtcaagaattctacttaaaaaaaaaaaaatctagtgtactcttgtactcaaagggatgagtacaatctatcacagggacacaaatgtgaccaaaaaagtggttaaaataaaatatgaaactgaagagaatgaagatttgagcatgaccttctctgtatcttctttccaaagtgttttcggatctcttatgaaggggatttaaaggcttttctacaactgctactgcttttgtcaattcattcattcaagacacaccaataaacatgcacgagctcctcttgtcctcatagggctagagaatgagataggtgcaaagtttattttagcagaaggctttcttttcacaaatcagaaattccattgtatgtattcccttaaataactggcaaggggaccatcggaatgagctatggcaaaaatccacctcagtctttacagcttcagggtgatggggccccagatcagaattgtaaaatagtttagagaatcttggaacataaaacatggtgcagaaaaaccaaggaagatttaatcttatgtatggaaaggtggttggtagtggagggggcaatggaagagagtggcttgggatcatcattaatcattatttaagtacctataaagtgaaaatatccttctggaattcactgcaagtgacactgaattcttctactaagcaaatatgtgatgagttgataaaaaagaaggtcctgaactcttgacaacagatataatacagtgaatacagaaaatcaaaaacatgctttctatctgactcaaaataaaggtgcacttaaacttgtaaaagacaacatttttatttgaatgatatgacagaagtgtcacgggagtgttacctgctataaagaaagcctaagaattattacctttattagaccagtgacactgagctttagccatacatttctaacttctgtccctctacagagacaattttcttttcttaaataaactgtcatgctagtgttaatatattgttggctctctcatgctctgagaatactgctgatataaaacatgtatatgttagattggtaatagtatctttagtgtagctgactagaacaaatgtgtttccctcatggctgtgctaatgtgataaaggaaaattggctgttcatcagcttttggctgggtaaagacagtagagatggaaccacattcttttttatgcattaataccactgagaacttttcactagttatatttcatgtgcctgcatgttgtgcaaagatgttgtaaaacatgagataatgctacaaataacaaagtagaaaagcctgtatcttttataatgataacagtcaaacaccaaatgacagtaacaggctgtaaaaaatgggatgcaaaaaaaatgcagccctactacccaacaaagcggaatatatccaggcccttgaggacttggtatatgatttgaggtatattaaagctttgttttaaaattaaatcaaatgcaacactagatcaatggatttaagaaagaacatagtttaaatgaaagtagggtggttagaatggagaaaagccattgtgggtaacttcttgaaataatccgtattaccaagtaattattgtagtaacttcctgttttttttgttttgttgtgttttgcttgtttttttggggggggacattgaaaaagatttttaaggcaatagtacacatgattttaagatgtttgagaataaatgtttatcttcattaattattgcaagtctttttaacataaaagcattaaaagtataaccagtttcaggctcacagcaaaactgagtggaaatttcagagatctcccaaacatgctgtacccccatgtacccacagcctccccctctattaaagccctgcaccagagtggtatatttgttacaattgccggacctacactgatacatcattaccactcaaagtccatagcagaatagcatgttgaatgttttgctatcattttaattaaaatgttaacatccaacctttcctttgcatgaccttaaatctcactctttcctcccctctctcaacccctcccctttccagagccttttatttgccatttcagctccttcactaattagagtaccaattattcctttttcatttaagctaaaagcacttgaacaaaaagactatttgcagagatgaagttgatgtccaaacagctgattagtttatttagaagtgtatgcaattaaaaattttgtgcaggtatctatgggtgttttccataaaagtttgatagcattggctattctgggctccagtcgcataaacaaaaatcccatagctttttaatcatgtaatccaagagttatcaagctacaacctgtgggtcaaattggctggccacctgtttttataaataaagttttatttggacacagccatgcccatttgtttatatattgtctgtggatgcttttgcattacagcattagagttgggcagttgtgacagtaaccatttggcccataaaaccaaaccatttgacttgcagagaaaaaaacattctctagctatttacagaaaaaaaaaattgctaatccctaatatgtgcagttattaggctacttgcttgattgattagtctagaatatgattggcaactttttgttaccctacattggaaaagtatatctgaaaatcaccaaccggataccaatacccaagacagtaaattcaagaaatatttgatcctagtaacttgaattatatccacatgcaattctttgttgttatatctggttttaattatttctttcccttgtactcattttgctctatttccaaatatagccataacaaatttaatttgtatttaaagaagtaacatatcctcaaaaaccctgtaaaacatggcaaccagagctgttacatgtatgggacaaactattatgtatacctgtgaacaccctgggagatatcatcacagcacaaaatgacactatataggtttatatctagataaacacatggagatatcactgagctattaaaataatgttttcagtcttcccagctgaacaaagtaaagaagaaagaaagttacttaataaaaactgctgaaatgtgtttaatataaaataaaagtttatgcacttaaactaataatggtggtaatttcttacaggtgcatcagacaaaaatcagcttctttatcaatggcgtggagaaggatcatacacctttcaatgcaagaactctaagtggttcaattacagattttgcatctggtactgtgcaaataggacagagtttaaatggtaagtttctgacttcagaatgttatttatttcatccaattacattgttcttaaaaatgcatcaaacaaataatattttaaaatatctacgtgtattcatcttctagggctactgaacaaattaccaccaactggatggcagattaatgaaagtaaaatttattttttcacagttttggaagctggaagtcagaaattaagggttcagtggtgttggttccttctggaggctctgagggcaaatctattccatgtctctcttcgtggtagctactggcaatccttagtgttcctttacttgctgcttcctaactgcaatcttgcctcagtcttcatgtggccttctcctctgaatcttctcccctttacctctgttataaggacacttgtcattggatttagggcccactcacagtcaggaggatctcaccctgagttccttaacttaattatacttgcaaagaccctttttccaaattaaagtcatagttacaggttccagatggataatagatcttttgggatctactatataacttactacatttgggaagctttcaaatataaacttctttattctgatcagtttttaagtaatttcaatgtgtaataaactatatttcctttctgtctcttttctgaggggtttgcattttcatgtagagaattgttaaagtagaactacgaagtattagatggaacctgagaaatagtattgacatgtaattaactggactgatgtttacatttactacattaaaaatgggccatatagtttaagaagatatcatatactatatattgaataaaaccagaagttgaaataagaaattatcttgaaatatctagtacagtggtctttaaaatgcctgcatattaaaataaaaatagtattttatattattatataatatatgctcattataaaaaaatctaaacaatatggaactctgtgaaatagaaagtattttccatatttctatcttcagagatagatataatttaacttttttatactcctacagatttttagtacatttttagctagagatatagttataaatacatttttccaaaaataaaattacaatacatatgcttcctctgagccttctaaaaataaatacttctccttcaaatgttataaacaacgtttcatgtcaatgtatcttctcatttagatatatgttctcatttaaaatggctgtattctatgcaattgtatagttgcaatccatgagatttcttaagctcctataatgaacatttaggtttttttaatgtttcagtgcaattagcagttattttatggaaaatattatatatatatccacatatatttatatatctgtgtctatatctacatttccatttatatatatcaaccatcaatctatcaatcatatacatagatgtatacatacgtacatatgtatttgagcagttgcctgattgcacagttccttaatatcctatttggtgccaacctgcgtgaattcatatcccatttcctcacttactagctatatggcctggcaagatattttaatatctctaaagtgtagtcaccccaactttaaaatgatgatgatgatgatcataatattgatttcccatagggccaatgtaaggatcaaatgaagcaatgtcatgtaaaacattactgtgtttcaagcacctggcatgtattagatattcaatatttatttgttaaatgaatgaatggatgaagtgctaagcacaatgcctgtatataaactatattttctctttcttgggcatggggctggattttaatgtacagcattgttaaagtaggactgtacagtattagatgaaaactgagaaataatattaacatataattaactggactatgtggtttatattttcgcacactaaaaattggccatgtagtttaagaagataacatatatgctatatattgaaaaaaattactaaactatatcagtaaataataataatattattattttattattatttttttttgacagggagtttcgctcttgtcgcccaggctggagtgcagtggtgcaatctcggctctctgcaacctctgtctcctgggttcaagtgattctcctgcctcagcctcctgagtagctgggattacagatgtgcaccaccacgcctaacttttgtatttttagtagagatggggtttcaccatgttggccaggctggtctcgaactcctggcctcaggtgatccacccaccttggcctctcaaagtgctgggattacaggcgtgagccaccgcaccctgccgtaaataatactattattaatgttattataattatttccaaaaaataaattcatagaagttgaatggctgggttgaagtatatggtcattttatattttaatacatattacagagattgctctaatgcataacaatgggctacctccagaaaggttgtgaaaatttataacctcattaaaatatatagccaagtacttgtttccttaaacactaactatccttacaaattatccacttttttttcacccttgacattcctctaagtgaaaaatattgttgaatgctgactcagaattatttggccattaatgagtttgagtagctttttacgtatgtcttgatcatttgcatttcatttatgaattccttattcatacaatgtgtccatatttatactctataattccttatttatttataaaaactcatttatgttaagaatattatgttgtataagttttcttcagttttttgatggcttatgaactttgtggtctagatattttaaagtaatcctttaatatttaagcaaaataaaacatgtatgcaagatagtgcataaatataaaaggtatagcttgatgagtttttaatatttatatacacctgtgtaactctcatttaaaaaaagtcgtagaatatttccagaatctcagagtcccctaatgaacatccactgtaaagataaaaacagaatagcatcaatgtagccctctataaccatagattaatgttgcctgttctcaaactatcatacaaataaaatcatgaagtaggtactcttttgtgttctttttgcttagcactatgccaatgagatttttccatagtgtatgcagttatatctttagctttagcaaataattctgtaaagttttccaaagtgggtgtcccaacaagcaacatttgaggatttcagttgttccacatccttatcaactgttagttttgccagatgttatcattctttgccattcttgtagccatgtagtgcatttcctgatcattagtgatactgagatcttttcatgtgcttatttgccaaatgaatatgcttttttgggaagccttttgccaagttttaattggacagtttgtatttttcttaataatttataggaggtcttccatattttgaatatgagttctttgacaaatacatgatagcaaatatggtcttctgggctaaggcttacagtcacattctcttgatggtatttgtcgataagcagatcttcttaattttaatgagtctaatttagtcattgttttatacttaatactttttgtgttctgtttagactatttttgcaaaccctgatatcacgaagatatcctcctacagtttattcaggaagctttattattttacttttcaaattttggtctatgttctatctggaatagattttttgaggttatataaggtaggggtcaaaatttttgtcccacctgaatgtgtaattaacctagaaaaccttgcctcttgaaacaaatcaatgtttctaccattctgcagtggtaacgttgtcgtgaatcaggtctctgtatatgtgaagatgggtttctttctgaactttctattctgccccagtgatctgtctgtctgtctatacttgggccaaaatatttagttttaattactgtaacttcatacatgtcttcatatctagtagttctccaactttttttcttttaagattgccttggctattatatatgaattttagaaacagtttttcaattttcataaaaaattctgttgagatttaaattactcatttgtatttaggagaatgggcatctgaacaatatcaagtatccagcccataaatgtaatatattccttgatttctcccagcaatgtttttagttgtctgtatagaggtctcactcctatttgttagacttgttcaaacatattcattggttttccttcttaatagactatttttttagagcaattttagagtcacagaaaaattgagtggaaagtatagagagttccagtatactctctgctcctacacacgcacagccttccccattgtcaatatccctcaccagagcggtatatggtatatttgttacaattgatgaacctacattgacacatcattatcacccacagtccatagtttacattaaagttcactcttggtgttgtacaacgacaagtatccactactccagtatcctacagagtagcttcactccctaaaaatcttctatgttcctcatattcatccttatctctatcctaacccctagcaatcactgatcttttcactgtctctgtattttcaccttttctagaatatcatatagttgggataaaaaaatcatgtatcctcagattggcttgtttcactgagtaatatgcatgtaagatttctccatgtctttcatggcttggtggttcatatcttcttagtactaaataatattccatggttagatatagcatagttgatttattcattcacctactgaaggacatcttggttgcttccaagttttggcaattatgagtaaagttgctataaacatcagtgtgtaggtttttgtgtgaacataagttttcaacttataaataccaaagagcgcaattactggatcgtatggtaagatatgtttagttttgtaagaaactgtaaaattgtcttccaaaatgactatatcgttttacattcctatcagcaatgaaagagagtccctgttgccccacatcctcaccagcatttggtattgtcagtgttctggctttttggcctgttggttttcatgcaattatacttagtattgtttttgaacttcatttgctaattttgttactattgcattaaaatctaatcagtttttatatttacctatgtttagtgaccttgccaaactcattattatgataggtacacaatcctatcatttgcacatatcaggaactcaactctttttgaatgtttgtaataaatgtatataatggacatgccataaatatctcctgtagatatttttgtctgatgcacttattaattctgaaataatataaaatgttattttgtttttctgtatgacctgagttattagaccaatgtctagttttaaaaaagaaggtatatatttttgatattcaaaacactgtggttaaattgccaagctctggtttaaatataacccaggtgtgcttctttgatcaaaatattaactctctttaagtctggtttctaatctattaaatggtggtttaatatataattcataggaatcttataagaattatgtgagatgatgtatgtttagaatataagttgcttgttgtatagtaaatgtgcattaagtggtaactatttttaaactctttgaacatcaattttcttattgtgaaacaataagatagggataacactatatttccatatgattgttgtaccaatcaaaagagaaaatatgaagaccgtattactttagtttgtgtatgctcttagatcaagctaaactcatgtgaagaagcaatattttaaggaacttatatatttaggaacttggtttgagtaattagtataatgcataatcttataaaatactctgcgtgaagaatttttaaataacacattaaatcttgtgagccttatttcaatatttaatccccattagtacttctaaaagtgttttattgcaccaaatgttgctcaaagtatttgatagcgccataaattagtcccctatgcactgcagggttaaaatggcttgcttctattctacttcagtatactaaatgttggattaatgcttcaaaagaacagtgtgaactgaagatgatatttttaaactgtgtagaaataaatttcactcctgattagaaaacatgtaacaggaaaccggtttatttcaaatattatttagttttcattacaactttctcctttatgttcttgacatctgagagctacagaaggaaaaggatattttaaataatttttatctttattctatcaatttatatgtacagtcgtacctactgtatcttttctctaattagagatggcgtatagactggctcattacttctgcctaatgagccaggctccatgccacctctctaatcagaaaagagataggtacagaatgttcctatggacttattataaatcattttctttctcttacttgctcctttttttaatcaaaaaattaagtcactgtcctccatacttttgtccatatccaagatggtttctttcaaaagaggtaattgtgcaagcgattactgagctgaattaaaggtgctctcatgcagtgccaggccggctgtctctgctttggaacagacactgcctcaaacacaagcacatcaaatgaaggcctatagcagatcaagatggatcttttctgtctttctctgattaggtttgacttggttctctgtttctgcacccagaaagtaacaaccttccatatgagtgttggctactacagagctttttctttgagtcttatctctagcataactctctagaaaaatgtgttgccagtgacactttctgttactgcaggacttgtctttgctttccctggaaaagtaatcaatggaccaaatgcatgctttttactgaaccctcatttatccttattaatggtataatctgatttgatcaggctgaattttatgtatacaaatagaaacaccttagaccatctatatcaaccaaagtgtgatggctcctttttagaacattttcttttagttgtagatttattttagtgcttccaattgggtatataacctggagcacttgtgttagcagatatgtagttatgaggagtcagcaatgtcatcgtggtaataaaccatactagctctccaaattttggatttaaaattacagaactacatgaatcaaaacttttcccagttatttctgaacttgtttatcaacagagttctagttgccgattaaaggtgagaatttctacattatacattcaaatgtgcatagcactttcttaagaagatcattggtcattaaggaatcaataaatatttgttgagtgtctgttaaagtgaatatgcagggaagaaaaggatcatcgtctaaagctaactcctacttgccttcctttctgtgttttcaacgttgtgtgtcttagcccatatgcttgtacttgattctaaagttggaatgctacttctaatttctaccagtttcccatgggttcacatttctaacctctgctagatacacaaactccattttagttcagctgaaatcatgctaatttttttcagagagaattatttttgggaattagatttaaaaaaagcttagaaagtattgaaattgactaagagattggaatggaagaagagtataggaatatagtatatagataggagtttacttagtttcagaacattgcagacaaggtatctagcaatattatcagacaagttatgttgtatatttaaaatgatgttaatgtagctctctcaaccatactaagtaaaaactgctgattaattaaaatttgaatgcaaaatatgcaatcataaggtagtagaggaaaatgaaggcaagtgtttctataattctagcatattaaggacctttattagcacgataccatgtccagaaacactaaaggaaaatattgaaacatctgactattaaactgggaatttaaaattcaaacaacgattatcattttgtacttgatagtttggcaaggactagaaaagcgattataccggtgttggaaatagtttggggtaacctggcaaactatcaaaagtaaaaatgcgaaaactacttaatccaagatttctacttccaggacactatctcgagaatataattagacaaagacttaaatacatactcaaaatgttcattgtagaatgatttaaagtaacaaataactggaatcagttaaaaacttcaaaaaggaattgatttaataaattataattcatgcctactgtggaatagtatacaccatcaagaggaatgaaatatgtctctttctatgtacatggcaatgggttcatgatgtgttattacatgaaacaaacaagattgtatagtacaaaattctataaatttaatgtatatgttataaacatacatatacatattaaagttctggaaggaaatatgccaaaatgttcttcagaatgttagtaatgttaatctctatgagtgggattgcaaataattgctttttaaatttctttttgtgcaatttttttcagtaaactataattttataataagaattaaaaatattttccaattttggacaaaataataaatggaagcattttcagaatagatttattctatgaatgtaacaagttcagccagagacacctaatttgtatagtacagagggtggtcttgaaaatgttagtcatttaaattctgtacttgtcacatggattcaggaaacacaagcgttcattggacatttaactcattgtacatacaattattattactataataatttgtgcctgagaagcaaagcatgagatttagaatcagacagatttgggtttgaatgctagttctgcttcttaacagccaagtgactttggcaaagaatataacttctcaatccaatttcctaatatgttttctcatttataaaatgtgttttatacacatacttttcagggtgatcagagagcttataaataacacatgtttgattcatgttaggtattcaataaaatttcgctatcataaatattattgttaatttagttattaagtttattgactgtgatacttaaaattttaacataatggccatgaccatatttaattttttttggctgaaaatcaaaatttacttagggtgagggagaaaaaaagtccagtttagattcattatgtagcagatattttaaaattctgtgttttgtctatgtaaaccccacaaaataatttctctctctttttaaagatctgtcctttctagtgttcttcaatgtttcctgttcatcctcacttccacctgatgctatttcttcttaatccgaagaacctcccttttcattgcttgtagctcagcctgctgaagcaaattctctcagcttgtgtaaaaatgtctttacttttgcaggatattttcatttgatatagaattctacattgattactgttacttcttttagaactttaaagatgttgtttccttgtcttcttgccttcattgtttctggtgagatatcagccactatttatataaatgttttcttgtatactatatgtttctttccttctttctttctttctttctttctttctttctttctttctttctttctttctttctttctttctttctttttgaagcagagtctttcactctgtcaacccaggctggagtgcagtggtgcgatcttggctcactgcaacatctgcctcctgggttcaagtaattctcatgcctcagcctcccgagtagctgagattacaggtgtatgccaccatgccaatttttgtattttcagtagagaccgtgtttcaccatgttggccaggctggtctcgaactcctgacctcagatgatccaccctcctcagcctcccaaagtgctgggattacaagtgtgagccaccatgcctggcctatatattgttttccacttgatgctgttaagattttatttttatctttcatgttatcagtttatgatatgcctaggaatgattttcattatatttgtcctgcttgaggtttgcttaaattcttggatatgtacgttggtgttttcattacatttggaagttctgatagttgtatcttcaaacttttctttctttttttcctttttttgcttccttttctttcttctgtaataagactctagttagattgatgttagagcactagatattgtcccatagatattgggtacagttttgtttgttcctttgttttcattttccccactcttttttgtgtttcagtttggatactttctatttgacttgtctttatttcactggtcaatttctcttttgtgtctaggctgctgctaagcccatctagcaaactgttgatttctaaattatacttttcatttcaagtattttcatttggccgttttgtagacttcatctattggctcaaattcacccatctatttgcatgtattattcactatcacccctagatcttttagcatttatattataggtattttcaaatccctatttgataattccaacatctgggccatgtctgcatctccttctattgactctttcctctctttacaaagggccacattgtgttgatttctcatgtgtcttaaatatttttattgtatgataaacactttgcgtaaaagaatgaaagaggtggaagtaaatcatattttttggcgtttttccctttacaaagaagagcactgctggttctatgagaccttttgaatgggggtgggcagtaggaaagaaaaaataccaaactgacttgaagttgatctgtacgtgggctttactacagttttaatattatttagctcactactggtttcagatatctgtggatagaattgaaaatagttagacacatgtctggtggggcctccttagaattctaatatgtcattctggcctctgtatggctgcttctttcttactccttctatgcctgaatcctctatttcttacctctgagctaagtatgggagtagccctgggtctcgtccaatgagttacatgtccagtaaatgtttgtgtttcctacaaaaggcttattactttctagaatttaattcatttagttttttctgtgcgctctacattttgattggttaaaaaataatgactttagggcttatctggcttgttttggttgttagattgacagcaaagtgatggtcccttacaactttttacatttaaagcagatgttgaactattataacaacatctaatttatacccctttttttctttggcacaactctgtctatacttaactctccaaccctctagattgtttcagctatggctggtcactgactctgaacaaaaaaggtgcatattacttggccccaaagattattttggtagaattcaggcatcgacgttttaattacctcctctaatttttcatggggattttcagcttttgtgggccctaatttatccctgactcttaacttttatatctgtttctttggtttgcctgaaatctgtttactgctaatatttaaaactgaaacatgtttttttataaatctagccattggatcttgtttcactaatgatcatgtggcatcgtttaatctcggtgcccccagcggctctgtttgttcagtttgtatagcacatgcatctcttgtgtttctttttctgtcagatacataatcatattgattagtgtataccccttataccctgagtccaaaaattcctcatccctcccgggatcttcaaatgatttaacgactttccactatctctcactttttgatgtggtctgttccctccttactcaacttaagtttcatggccagttattataaccacttcttttcatggaactggacttccctgccgttttttcttcacttctactatgatcttggcactaccacagcataggttaaatatacccaaagaggacgactcttcccaccttaaactcatgaccatgaacttcctatgtttcctgatgctgccctgtgatcattccatatttccctcattcattcactttcctgtcttatgccaactatttatacattttcctttctcattatcctgatcctcagtgattatattacctccaactttaccataaaaattaacaaaaagaataaaagagcttctatagatttccactgctatatttatccaccactggcataccacctattaatagatctgaccaagaatatcttgcctcatttttccccaatttactgctgtattgtaaaattttcttgtattaatggaacattttcaagggaataaaggcatgttgttatttttccatgaaaaattattcttgaccctcccccatttcttctactagccattgtcttatttatttgctctccttttagcaaaacttcaccaaagtatattcaaccataggagcctttaattcctcttttcaaattccaccatctacagtcagactttagctcaccactgcacttaagctacacttgtcaaatctctactcaccttcacattataaatctaatagttaatttcaagtctttatctttttgacctattaacatcatttaatggagttgatcgctccttcctccttggtatacgttcttcacttggcatctaacactccatcatctctctgagtttctagttgctgcgtctcagtttgatttactggttcctcttcatctacttgacctcttagtattggtaccccaagccttaagacttagctctgctcccgtgtctacagacactcactcccttaaagatcacctccagtcttatagctttaaatgtcatctaagtgacttgacctccaaatataaatctccccaccccagcctctttcctgaactccagacgactctgttacatgtatcaaactacccaaagtctccatttgaatgtttaatttacatttcaaaattaaacttactttttttcaaaatggaactggttttcttaagctctctcactttgatccatatactacttcttccatggtcttcctcatcacaagtgaaggcaatttcatttttccactaagacagagaaaaagatttggagtcatccttgtcaattctctttatctcatgttcaacatttttttttttgttttgcaaaatcttgttggtgttagaatcaaaatatatccagattttgaatccttcttagcacttccactagaatcatcccagtccaattcatggttgctgctttgccgggattactgcattgtcttttaactacttccaggcactccgctttattctcaacacagcagccataattgttctgttaaatatcagtcaagcatattacttctctgctcaaaatgctctattgtttctccattttaccagagtgaaaaccaccattcttactataacctacaagacctaactgagctaacagcagttacttctctggctttatttcttacatttgtttattttgttctccttgttttacacaaattggcctctttgccgatttttgactatgggaggtgcacttctgccttgataccattcgctgttctttcaacctggaacttttcacctcctgatatccatcaggctgactcccttacctgattaggtctgctcaataccagtttcttaaatacatctttcttatcaccccgtttacatctgcaaacaccacctccccactttgggtctcattatgttgctctattcttttccatagcacttagcatctttaatgtattatagaattgacttatttttgttgaatatatctgtttttccctctataatataaaagagaaagcaagattttttttatttgcattactcactgatataccccaggatccagaagattgcctatcacatggtagctactcaatacatattttccaagtaaatgaatcgatgggcagcttccatgcagcattaagcctgtgggtgtgtggaatgcaagaattgaagcttgggagcctctgcctagatttcagaggatgtacagaaaagcctgggtgtccaggcagtggcctgctgcaggggcataaccctcatggccctagaacctctattagggcagcgaaaaggggaaatgtggtgttgcagtctccactgagtcccctctaggacattgccttgtggaactgtgagaagagggccaccatactccagaacccagaatggtagccactggcagctttcaccctcagcaaggaaaaactgcaggcactcagtgccagcatatgagagcagccactggagctaagccctgcaaagtcagaggggtagagcttcccaaggccttgggagctcactcctcccaccaatgtgccctggatatgagacgtggagtcaaaggagattattttggagcactaaaatttgatgactgcccttttgggtttcagacttgcatgggggctgtagcctcttttgtttggctgatttatcccgtttggaatggaaatatttactcaatgcttgtatctgaattatactttggaggtaaataactgggttttgattttacaggctcataggtagaagggaattgccttgtctcagatgagactttggactttggagttaatgctggaatgagttaagactttgggagactgttgggaagggataattgtattttgcaacatgaaaatgacatgaaatttgggaggggccagaggcagaatgacatggtttggatctgtgtccccatgcatgttcagttgtaatccccagggtggaggtgatacctggtgggagatgattggattctggaggtggatttttcatgaatgatttattgtgatagtgaatgagttatcacaagatctggttattttaaagtgtgtggcacctcctcccactttgctcctgctttccacatgtgatgtacctgcttctccttcaccttctgccattattgtgggcttcctgaggcctctccagaagccaaacagatattagcactatccttcctgtaaagcatgcagaactatgagtcaactaaccctcttttctttctaaattacccagcctcaggtatttctttatagcaaagcaagaatagactaatacattatcctttgttactgatgtctaaaaatcttttttaaaaaaattaaaagcaagtatattaagacagtaaaggaataaaaaatggctactccataggcagagcagccccaaggactgctggttgcccatttttatggttttttcttgattatatgctgaataaggggtgggttgtttgttagttttccctgaaaggggtgggcaattcccagaattgaggatccctccctgttttaggccatatacggtaacttcctgatgttgacatggcatttgtaaactgtcatggtactgatgggagagtatcagtgaggacaaccagaggtcactcttattgccgtattggttttcgtgggttttagctggcttctttactgcaatctgttttatcagcaaggtctttatgacctgtgtcttgagccaacctcctatctcatcctgtgacttaggatgacttaccctcttgagaatgcagcccagtaggcctcagccttattttacggagcccctattcaagatggagttgctctggttcaaaagcccctgacaattaccccctcctttttaaaagaaagctcttaatcttaagagttgtagagggatgaagatccatcttctctaacttcttcaagctgaataggggtgatgatattcctgcctaacaattagggtctcttgtctttgggatagagaggaactcaatcagaaaatgctggtatgtcaaggtccattcagaatacttgagttctgacaaaagttgatacctggaagattaataagtatttaatttaagaaaacattcggtaagcttatcctacacaaagagtataacagcaatacattccgcagcagtaaagcaaaataaataaaattatcacaactaaactaaattagaagactttccatgaactgggcaattgttagaaccaagctaatatgtggttgctagtaaatcccagtatgtgcccagaattagaatattgatccagattttgacattgcccattcattttggttttttttgaatagtagtcagagatcacttggtggtacacagaaataagcagagtctgtctaaattacagaaaaaaaaccttaaacacaactaatgagactagaatctaataacaggtgtaccatagtttttgaagcaattctttttcttttcagtctctcatttttactaaagacaaattataatagaatcgatttgtgcgcaaaaatgagctttagtcttatacttggcctgattacttgtataaaatgctaaaaaataactatttttcacataggattttaaaattggctttgatggaactttgttccataaaaaggaatctcagataagacctttttaaagctgagcccagccctgggtttgtacaatcaaatacctatgagttgggttaattcctttactcttgaggtcctaagatatcttcgggcccctgagtctatcagaaagtgacattctttacttatcacaggtcaggaaccctgtacagggcatgtgtaaacaaagaatgtgaccagttttcccaaggggtttttattggctttataagtcaagattgattccttaaaggaaagcacaccattccagtgaaagtcttggtaaaataacaaatttttccaattgtgtcctgttacaaaataaaacagatgcttattgcacttatgcaaatatctattgtcataagttaagaatactcacaaatagtttctaaattctgaagaaattaggtagaatcaaatatgccccaaattttgtttacaggagtaaaatttactcaattgttaaaaagctgtaaatagcttaaaagaaaagttgccttggctctgatagcaaaacaaaggatcagcaacattttaagcaaaaagttttaaaagattacttcagctatctattattcagcccatgcagttaactcttgttcagcttgatattcatgaacatttcagctctccatcagtactgaaagttttatcctctcttctaatgtcacaatcttcaaagttattagaaacgtgcattcaagagcacctgtcaaaatcctatagctgactctaaacttactttttaaagaggattaaaacaggtcaacaattttctatggatgacaaaaagttttagaacgacatatattaaagccacaattgataaagaaattttggttagttctgtgacatacaatgattttactgacaattataactattactgataatgtacactaagtcatatcagaattacaggactttcccataattttggaacacaaaccaataacatatttttacaaatacagtccaaagaaagcaaagaccatttcatatttttctatgcttcctgtatgatatttataccaaataacctgaatatgccattttggactttaggccacctaatagctaagagattaattaggtcagaagaagacatactttgtaattttattttggaaagcttgtcaaatattaaaggtttaaaacactggatatcacaaaatataattccaggtcatcataagtcattcattaggccaaaataataactcaaaaatatttaaaggggaaaaacctttactcattaatagagggaagacttagatctccaaaccatctgtctcttttctttcctttcctatataaaatttcttttttagaaacaacctctttgcatagttgggaatatggctaattccacatgtccccaggccttatctagaatctaaagtctccaaagtaggtaaattgaacaattttcaaaagtcaaagaagcagtttctgaccttaaagcatttagtaaacttaatatgtgacctgcctaatttagaccaaatgtctttattttatcaataatttttaaagctgtttttatttcccaaacattcctaaagtcacatgaactaaaagtgattacactttttacttttctgacaaaatatttgatttagacacttattatttttaaaccgattaatcaaagctcttttatatcacatatgcagcacatataaatacacagacagaaaaagatccagtaagatttttcatttttcggtttcttaactggattactggcttcagggtggagccttagaggaacagagccaagaatgcgtgaaatttctaaagcctaataagcaggcacagctggaaggcaaactagatcttcaggaattaagggttccattttaatagcagattctggatcccaaaaagagggaattagcccatctcccatgggagtcttacctctcagtggggagtgggggcatttccataacttctaagtgaccaagagcatgcttctctgatccaaatgtgcaaagagccaagtattccataactgccattagccattctcaaaagtgtatttcctacctagttattgcataccaaagctctttcctaatgtaaagtgatttctgatacccccaaaagtaaaaaacatcagataacgcaatgcgaaacacaagacagccttagattttgagagggatctatccatttccaattcctgggatttcatgaggaaaacagatgttttttctcaaaatggggtctgtggtgctcctttttttcccaaggagtcccaggctgttagaacttaaatatctgcttttaattaagctgacttttaatggtactgctgtttttaaaaagtcctcttaaatttcttattacctgactttagccaggcgaaactgtcaataattctggcttttgaactttatcaaaggtaacctcccaggtgttcagagaaaggaaaattcaagacagaccattgaggggaagagaatcaacaaatgttcatgcgcatatcaaaccagaaaggactcattccctaagctgggaattgaaccctgaacctgggtcaccattgtgaaaagaaagcctcagctactgagctactcactgggcagtttccattgctcttcccagaaggagtctagagcagcagattttgagcttgcaaaggttttaaatgctcaagataattttgtagagctaactatgacatgaacccccaaattcctgttttctggatggtagagacctagagaaagtaccgccatgtggtcacaaggtcaagctcccaaggacataactagccagtttgctgggccgtcttgaacagtaggcttatggggtcctaagcttgtgttctatcctaaggtacccctctttctaacagaaatatacaggaagacaaattcacagtgcaaagtacaacagattcactgtagcttaaaactagcctcacaaatcctttttcacattaatcagaactttacagaggagataaacagtgatttttaccattctttgaactagtttgcacagagagaaagagagaggacagaagtctcactggtaagaaattcttacccttttgctggcatgccaggcttctgggttccctttccctgagcagtcctagtgacccagcttgacgcatcatagccctgggggccaagctgcaacacaaaggaaaattgtctttttttctgtcctggccagagcaaaatatgtgtgacatagacattagccactctgctcagcatccaatatcaaactaacaaggctcaaatttgcccctggttggaccctgtcatcattaatccaacctctgaccagaagtttcaacatgtggtctctgggcaagatggtcaccctgagtaagagaaaaggtaagaaagggaaaggagagaaagaaagaaaagcattggctgcatacagcagggtggggaaggcaaaataatcaaggataccagagaaagaccctcccattgcgcaaaagttcaggctgccgcttgaagggatctgtcatgaagggatcttttccagtagtcccattagctctcaaacatcccccttttgggaggaaaaagctccccaagtcccacattcacatgcatgcctaattatgtcacccacagccatcagcaaagagggcaaggcagattaacccaacgagaatagcagttaatatctcgtattgccaaacccattattagctgagagggactttactgagaggggcctgaaaccccctaaatcttaggaaggactctaaccttcttaagttgggccttgaatccatgttctgtcaagtgtccttgtcttttattaagaggggcctttaaccacctctgtcttaagagagactctaacgcccctaaattaggcctctaacccatttccatcctttacccaagcaaatgtaccccacttacccagagtcagccaataagtgctgaagtctatttcctttgggtcaggggagtctcctccgtgttgtcccttccatggttcaccagaaagatgttaccagaaagaggtccagatccagaccccaagagatacattaaaacaaagcaagttttccttttgaacttgtcaaaaattccatcttgtaaaggatattaaatgttgctttaagctgaaccttgagcaaattaggtggtttgtgtgaccatacatgtatgtggtggcttcttgtttgcaacttcaaggaacaagtattaatagttcagtgtatgatgttgatttgagttgagcatttgcagtttggataatcttaaattttgacagacactagctgtggagactctttctgttactaaatccttttgttttgaagctattgccattcgtctttctcttgtcctttatattttttgtctgtttctttaagcttttattggaaatgtgcataagtaaagaattacttgtgttacttgccaagcaatgcacatttcatagttttaaatctgtaatcagcaataaaaatcctaaaatatgtatctaagaacatcttaaaaaattctttctcactcaagaaagaattcaaggtgagtccatagagtaaagtgaaaccaagtttattaagaaagtaaaggaataaagaatggctactccgtgtagagcagcacccccaatgtctaaaaatcttaacaatgataataaaagcagaaaacatatggtaattttttggcataaaacccttactgcagtgagcattaaaaacaaataaactgctttggttcttcattctagagacatcatatttaaaaacttagatttcattatttgattttcattttgttacaaaataaaatattcttagtgtcacactaaacagagatcagataattaacctgaccccatgatgcataattttaattttaatttcaatttgagttcttaatagaaataatgaaaggctgttatcatattttggttgaatggacacagatctatttttttatggtaccacattgagaatttgtttttttacatatataaatctattaatggtattgtcaaaatactgtcttttttttttttttttaagatgtagtattgctttgtcgcccaggctggagtgcagtggcatgatcgtatcctagtgcagtctcaagtaatcctcctgtcatagcctactgcatagctgggagtacaggtgcacaccaccatgcctggctaatttttttttttttttttttgtagagatggttcttactatgttgtccagtccagtttgaagcaatcctcctacctcagccacccaaagcataggcatgaaccatcaagcccagctagtcttttaagctttgttgttttgaaaataatgaggattattactttgatatcatattagaattttttctaaaaatttaacaagaaattatctttagttctgtataatctgtgggcagctatatctatttataagcatctatgccaattattactttacttctagttgtaatttaaatttgttttagttttcaaggacacagctagtcttaataacttgatttgtttttatttccatttattgagtttagcatttataataacttaaaaaaaattttatttcactttaagttctgggatacttgtgcataacgtgaaagtttgttacataggtatatgcgtgccatggtgatttgctgcacctatcaacctgtcatctaggttttaagccccacatgccttaactgtttgtcctgatgctctctctcccctccccacacctgaaaggccctggtgtgtattgttcccctcccttcgtccatgtgttctcattgttcagctcccatttatgagtgagaacatgtggtgtttggttttctgtttctgtgttagtttgctaaggatgatggcttccagcttcatcagagtttctgcaaaagacatgatcttattcctttttatggctgcatagttttccttggtgtatatataccacattctctttatccagtctatcattgatgagaatttgggttggttccatgtctttgctattgtaaatagtgctgcagtaaacatatgtgtgcatgtgtctttctagtagaataatttatattcctttgggtatatgcccattaatgggattgctgggtcaaatagtatttctggttctgggtctttggggaatcaccacactgttttccataatggttcaactaatttacattcccaccaacagtgtaaaagtgttcctgtttctccacagtctcactagcgtgttgtttcttgactttttaataattgccactctgactgaaatgagatagtatctcatggttttgatttgcatttctctaatgatcagtgatgttaagctttttaaaaatgtttgttgactgcattaatgtcttcttttgagaagtgtctgttcatatcctttgcccactttttgatggggttgttttcttcttgtacatttgtttaagttccttgcagattctggatattagacctttgtcaggtggatgggttgcgaaaattttctcccattctgtaggttgcctactcaccctgatgatagtttcttctgttgtacaaaagctctttagtttaattagatcccatttggcaatttttgcttttgttgcaattgcttttggcatttttgacatgaaatctttgcctatgcctatgtcctgaatggtatcgcctaggttttcttctagggttttaatgattttgggttttgcaattaagtctttaatccatcttgagtcaatttttgtgtaaggtgtaaggaaaggttccagtttcagtattctgcataaggctagccagttttcccagcaccatttataaaatagggaatcttttccccattgcttgtttttgtacagcttgtcaaagatcagatggttgtagaagtgtggtgttatttctgaggtctctgacctgttccattggtctatatgtctgttttggtaccagtaccatgctgttttggttactgtagacttgtagtatagtttgaagacaggtagcatgatgcctccagctacgttctttttgcttaggattgtcttggctatatggactctttgttatttccatatgaaatttaaattagttttttctaattctgtgaagaaagtcaatggtagtttgatgggaataggactgaatctataaattactttgcgtggtgtggccattttcatgttattgattcttcctatccatgacgatggaatgtttttccatttgtttatttcttctcttatttccttgagcagtggtttgtagttctccttgaggagctccttcacgtcccttgttagctgtattcctaggtattttactctctttgtagcaattgtgaatgggagttcattcatgatttggttctctgcttgtctatttttggtgtatagaaatgcttgtgatctttgcacattgattttgtatcctgagactttgctgaagtcgtttatcagcttaaggaattttggggctgaaacaatggcgttttctaaatatagaatcatgtcgcctgcaaacagagacaatttgacttcctctcttcctgtttgaataccctttatttctttctcttgcctgattgccctggccagaacttccaatactatcttgaataggaatgatgaaagaagggatccttgtcttgtgccagttttcaaagggaatgcttccagcttttgcccattcagtataatattggctgtgggtttgtcataaatagctcttattattttgagatatgttccatcaatacctagtttattgagagttttaacaagaaggggtgttgaattttattgaagcccttttctacatctatcgagatgatcacgtgattttgtcattggttctgtttatgtgatagattacgtttattgattgtgtatgttgaaccacccttgcatcccagggatgaagccagcttggtcgtggtggataaggatatgctgctggatttggtttgtcagtattttattgaggattttcgtattagtgttcatcagggatgttggcctgaagttttccttcttttttttttttttgtcatgtctctgccaggttttttgtatcaggatgatgctggcctcataaaatgagttagggaggaattcctcgttttcaattttttggaatagtttcaaaaggaatggtaccagctcctctttgtacctctggtagaattcagctgtgaatctgtctagtcctgtgctttttttggttggtaggctattaattactgcctcaatttcagaactcattattcgtctattcagggattcgacttttcctggtttagccttgggaaggtttatgtgtccaggaatttatccatttcttctagattttctagtttatttgtgtagaggtatctatactattctctgatggtagtttgtatttctgtggggtcagtggtgttatcccctttgtcattttttatgtgtctatttgattcttctctcttttcttctttattagtctagctagcagtctattttgtttgtttgtttgtttgttttcaaaaaaaacagctcctggattcattgattttttgaagggtttttcgtgtctctctctccttcagttctgctctgatcttagttgtttcttgtcttttcctagatttttttatttgtttgctcttgcttctctagttcttttaattgtgacactagagtgtcaattcgagatctttctagctttctgatatgggtatttagtgctataaatttccctcttaacactgccttagctgtgttccagagattctggtatgttgtttctttgctctcattagtttcaaagaacttcttgatgtctgctttaatttcattatttacccaggagtcgttcaggagtaggttgttcaatttccatgtagttgtgtggttttgagtgagttttttaatcttaactctaatttgattgcattgtggtctgagaaactgttataatttcagttcttttgcatttgctgaggagtgtttactaataactttttaaaatatcagtgatttttccaggtaatagacatttatggctttgaaatttcaaagtatgtttaaacaaaaaaattcatcaacaacctcctcccacattctgcatttacatttatcattatcatgtgtgttcttatacttttattattagattgaaaaatatacaattgccattcttatagattaaaaatggtcaaacattggctatttcaaatagttcaatatgtaagtatctcaaaataatataacacatgctgttatctttatgttgttagtatttatgtaagtgctcatatatatatatgcacatatataaaaatacagagtatatcttcaatttgcctttttcataaataatttttctgagaattacccattttgatattttgttcattcattttagtttctctattagtattccactttataaaaaaaagtatggattatgtatttgtttccatgtggagagttagcttttctctttatataatttatagaagattgcaattaatattttgtatgtctccttgtgtgcatttgtgagaatttgcacagaaaaagcacagtgaaaggtatcataggcttcttaagtattcttatcttccattttgatatatcgccaaactgttatctaaagtggttgaaccaatttgccttcctatggcaacaggtaaaatacccatttgcctgtgttatcaacatgttttgttttccaacatttttgccaaaatcatgagtataaaatactcccttattttcgttttaattttaatttctttagtaactattaaaatattgaaacatatggcatttgagttttcgcctctgtgaattgcttgttctggtatatctttcattaaattttccattgcatttccttgtcagtaaaagttacacttataatctgcattttacatgttttaattatattgattgtaaaaatatttccttcagtggtttgacttttaaaattttttgtatttttggtctgtcacacaagagttttaaattttaacattggcgaatatatcagttactttttatggttcagatagttttatatcttacttaagaaattctcttttatcatgatatatattgccttctattttttctgaaattaatttttgtataatgtgtgaggtagagatttaattttaacttatctttattggcacattcttgtcccactgatttttattgaacacacattatttcctcactgatttttaaagccacctctactgtatctcaagctccaatttgatggtagtgtgtttaacatcttgtttcagaggtcaatttgattaacttcttgccaaaagctatagcacttgattatcttttgatatcttgcagtggattccttcttaccagccttcttcagctattgttaggtcttactcctccaaatgaattttaggatcagtttatataaaaatgtttattgagattttttattggaattgaattaaatttatacaacagcttagggataatttatattgttatgctgatttttttcatccatgatcatagtatatcattctatttatttagatcttcttttatgtcttttagtaaatttctataaataaaatactcataacttataataaaagggataaatataaaatttattcctaggtatctcaaggttttggtgctattgtaaatagtatcttttattaaattgcattttatatttattgctgatataaagaaatattataaattgttatatatcattcttatttccaacaccattttggaacacattaattcgaatatttgactatagatttatttgaattgttgaggtagaaaaccatgtaatttgcaaataatatatttatgtcattctaattcttatggattttacttcttttctttgtctgattgtgaggtctagacattcctttaacaatcttggaaaaaaaagcagtgagagcaagcatcctcaacttgtcattgctttaatggaaatggctttacattttttcctttaaataagatgtttgccatatcacgttaaaaactttcccacctattcctaattgtttagggttttctacttgtatattatgtatttttcaagacatggcagatttaatttgttgagatataattttcatgcctatgctaccaagtgagattggtcctgtcgttttcctttctcttaatgtccttgagaacatgtttcagctctcccatttatgacctgttttaccttgggcaaatttcttaatatctatatgcttcagtttcctcatctttaaaattagcatcaaaagaatatctttccatagtgtttttatgaggattaaataaaataatatacataaagcacacagaacagggcctgctactcagtatgcaatagttattagctgtcattgtcatcattaatattaagatattttaaaacacttttcccctaaaatacttagagtactttgatgcatatcctaagatctgtctctggctgctatttctggacatttctttgttgtaatatttctggtagctcttacttgtgactgtgaattgtagacatttgatgcccacagactattcagctctttcaacttctaccttgttcctaaggaaatctgaatcaattcatcagggtctttcctaaagaaatttgtcgaagttatccaatccaatgccacgattatatttcttcttgtatgattgtgtttttgttgtttgtcaaagaaatttttgcccaagtcaaggtcacaaagaattttcctgtaattttttctagctatattatagttttaggttagttctattatccatattgagttaaacttttacataaggtgcatgatatgttttcaggtgctttaaaaaacataagatatccaatattccaggaccgttcttggaaagaagagtattctttttccatttaattttctttgccacttagttaaaatacagtggactgtgtatgattttattatcagcattttcattgctactgaaatgcagtaggtatgcaattgattttcatgtattgatattgcaacttgcaactttgctgaactcatttataattcctaatagattttagtagatttcttagagttttctatgtacaagagatagttttacttctactttttcaatatggaaagatttatttcttctgcttgcctatttgccctgtctggtaactacagaaaaatgttgactagaagtggcaaaagtggacattgttatcttgttcctgatcttagggaaaaagcattttttcaccactaaatatgatgttagctgttggtttttcacagataccctttattagatgaggaagttgtcttctttaatagttagttgctttttaaaaattttatcatgaagtgttaactttgactatgtagctattaagatgatcatgacgtttttgtcctttatttttccaagtttgtgtattacttgattacttttcgtacattgaaccagccttgcatccttgtgataattccacttgctcatgatgtatgatcctttttgttagtactgtatttggttcactagaattttgttgaagacttttgcatctgtattcataaggcatattggcctatagttttcttttgatgtctttgatgtttttggtattagggtaatactggtttcatagagtaatttggagagtgtttcttcctcttctattttttggaagggcttgtgaagtaatggtgctacttcttctttaaatgtttggtagaattcgccaatgaaagcatctggtcctaagcttttctttgtggaaatttttaaaaaattactaatttgatctcttttagtggtatagatctattcagattgctaatttcttcttaagtcagtttacatagtttgtgtgtttcttggaatttgtctattttatctaggttgtctaatttttggcatacagttgttcatagtatcccttatgatccttttttgtgactgcaaagtcagttgtaatttcccttttttaattcctgattttaatcattagagtcatctcttttcttggctagtctagttgaatgtttgtcaaatttgttaataatttctaacaatcaacttttgttgtttttcttgttgtttttctattctctattttatttgtctgctcaaatctttataatttcctttcttctgctagctttaggttgagtttgtttttctttttctagtttcttaaggtagaagattaggttattgatttaataaatttctctttaaatataagtgtttacagctctaaatatcactttaaacactacttaaatcccataaagtgtgatatgttgcatgttcacttccattaatctcaaaggatttttaaatctttttgtaatttcttctttgatcattagttattaggaatgggttaattttcacacatttgttaattttacaaatttgcttctgttattgatttctaattttttctattgtgatccaagaatatactttgcatgatctcagttattttaaatttatagagacttgttttatggcctaacatataatctatcctggagaatgtaccatatgcacttgagaagagtttgtattctgttgttgttgggtggagtgttctgttggtgtctattaagtctaattggtttataaagtcattcaggtcttccatttctgtttgtattctgtgtagttgctctctccatgattgaaagtaggatattgaagtctccactattgttgttaaatggtgaatttttctctttaaatctttaaatttgtcattttactgttgttagacacatacatgattataattgttttattttcctgatggattgatatcttaaaatattcttgtctctactaaaaattttgtctaaagtctattttgtctgatgttagcataggagctcaagctctcttttggttattgtttacgtggtgtatctttcttttcattcttgaacattcaatctatttgtttcctcgaatgtagagtttgtctcttgcagaactcctatagggggtcatgtttgtttgtttttccattttgtaaatatctactttttgattgaagtgcttaagccatttacatttagcacagtgactgataaggtagttacaatgtcactttgctgttggttttttaaaatatgatttatgtcttctaaatttctctattctttcactgtcttctttgggttaaaaagttatcttctagtgtataatttaatacccttgtcatttattctactatgtttgttgcccaggatgttatcattaacatcttaattcataaaaatctaattcaaattaataccaacttaattttaagagtatgcaaaattttgcacctatatagtttttgttcactctgctttcttttgtgccgttattgtctatggagattttttacattggatgcccatcaacacagatatataattattgctttataaagtcatcttttaaaacaaatgtgagagagaaaaagaattacagtaaaaatacatttataatctttttaaatatttacctatttaattacctttacaggtactctttatttcttcatctggattacattgctctctaatatcctatcatatcagccagaaggacttcttttggtatttcttgtagagcaagtctgatagtgataaaacctctcaatatttctttatctggaaatgtcaatttatcctgcatttttgaaggagagttttgctagaaaaaatagtttttggtgtacagtttttttttacgactttaaatatgtcattcttctcccttctggacgccatggtttcttcacaagaaatctgtggttaatcttattgaagatcccatgtaggagatggccttttctcacttgctgctttcaagattttctctttgtctttgtctttcaacagtttgatttttaatgtgcctagggtgtggatctatttgaatttatcccacttgcagttcattgagcttcttggatgcatagattaatagttttcatcaaattttggaagtttttggtaattatttctctaaatattctttcagtccttttacctcttctctgaaactcccattatgcctatgctggtactcttgatggcgtcccacagctttctggggctttgttaatttctcaacattctttctctttctattgctcacactgaataatctcaattgacctgtattcaagttcattaattatttcttctgatcatttagatctgctagtgagctcctctagtgaatttttcatttgaaagttttctattttctatttattttttctttttttgatgaaatgaggtctcactacgtttcccagggtggtctcaaactgctgggctcgtgatcctcccacctcagcctcccaaagtgctgggattacaggcatgagccaccatgcctggctaaaaattttctatttcttttctcatattctatattgtctaaagcatcattgtcatactttgctttagttctttggacactttgttttgttttgtttttagttatttgaacatatataaaatagttgatttaaagtctttgtctggtaagtttaatgtatgagcttacaattgacccatttccattgcccatttttcttcccctgtatattgtttgtaggagtttctttgcatatgccatattctttgttgaaaaccagacattttaaacacatagtgtagcaaatctggaaatcagattatttccctttccagagttgttttgttgctgctatttgtcactattactactgtttgcttgtttagtggctttcctgagctaattctgtgaagtctgtttctttgtcatatgtgataaatgaagtcattgtttgctcatcttagtagtcaggcaatgactgaacagagaatttcttaaatgcctagaaccaatacattttccagtctctggtgagagatctgtacgcatgttgcagaatgccatcaacactgaggcagtttaacactctcctttagtccccacttcctgcttgtgcagagcctcaaagtcgagctgaggtgagaccttaggactttctcaggtctttctttagcatgcgcatatacctgagcacatacttagccttttgcatgttcataatcttgtagattcgcaggcattttttaaggatttgcaaagcgtttatggacatgatgtttcacatcttctccttttaagtattttggattgtttgttgtttcttctgactgttgttactgcctgggtcaactgcaatgttaagcagttgccagtgattatttttagcaaataattgttttaaacaaacagagtaaatgctgtttccagtggatgaactctgagtcaattcaagccttactagtggggctttccatggtacttccaggcagatcgaataatgacaatcatctgaggatagagctttgaaacagctccactcccattctgatcctctagcagtaactaggctgctggttttcaccctgattgcaaactgttcattttcagggcttccagagagtggcagagaggagtacgggaataggaaagctaaaatgccatagaacatgttgttcttaccaatattcagtcatttaaaaaataaacactgtccacattgttgcaagtctttgctttatttccagagttctcaataagttgatgtgatattctttgccagtgttcccattgcttttatggaagacagactcttccattgttttcactctgccattgctgatgtccttttattcgtttcctcaatgtcttatagtttttacctatatacattgccttgctttaatagatttataactaatatttcacattttcagtgctaataaaatagtatttaaaagttttaatttccattggttaatcactagtatatagaaattaaattattactcatttaacttctatcaaacaaaattaactaattcacttgttatttctaatagcttttatgtacagtcatggaaattttctgagtagataattatgctatctgcaaatgagagtttatttctttccttctgattgttgtgacatttgttacttagccttattatctgtttttaccctgatttatatgttggattacttagttttcccatttgactaattttgttgtgccacccagttgtaatgcataacaacttctttccagtcatcacctgtctattttctgactagacagctatgaggtctttcttgtatgagtcatgtctatttccttgatcaatttatataatttagacatatctttgccatatgaatatttttcaaagaagaatttttatggaatgtttatcccaatgaatatctgttgttaaaaaattggcaagtagcaaaggaataagtaaaatttatttctatggctgtccttgaaatatttgatagtattctcacctcaaatcataattcttttatttgggatggatgattcacattaactctaggtctttagaaaacttgctgtaactcttttttatgaagaatttcttcaaatatgaattctttagcaatggatatgattgcaagctccaaaatttaaaactaaaatggtttttaaaggttataaaacccagcccctttattttatagataataaaatagatttcattatccccctgcagcagagcttccctttagctattattaaaatatagggagtgaattctaatttatcagcattgaaaggtacacctccacttctaataccctggtctgactgccaacatttttcacacatatgactgtaatatcctcctaactggcctcttggcttctactcttatcttcctatattctagtctcagaacttttgaataatcctgagatcacatcactcctcttctcaaaaccctccaatggcttcccattttactcagaccagaaatcaaatttcttacagtaggctattagactttgtatatataacaatttgtacctccatcctcccctctcccccagccagctacttgtctgacctaaccttctaataacctccccccttttattctgctccaggatgctagctccttgcacctcctctaacatgccaagcatactgatttagaggtctatgtgcttattaatgcctgcctggaacattttgcccctagatatacgtatgactcattcccattcccctgtcaatgccacattctcaatgaggcctctcttggacataacatccccactaaaatctagccatgctctccaacctgctctaatccttctgtttttcataaaatgtattgcattctaatatactatatgaatttctcattcattatgtttatctacgtgaatgcaagctccataaaagcaagggtattttgttgttgttgttaactgattgtacttttggcactcgtgaaagtgcctggcacataataggcttccaataaatacttgtgaatgaatcaatacgtaaaagaatgaagccaccctgacatttaaagccatggttcaggctttagcaacatcacagtgttcatcagttttgctgtctttcagttatggtaagtctttcaaaattatgaatggctagcccctgtttgttatgatctgggttctttgagataaaacacttccctagaggttatataaaatattttagacaatattttatcctgagaaagcaaattggataacatgaaatgcaggtaatttctttttttctccttgatatctcattatgttggcaaaaataggaaatgaagactgtcagttttccacggctgccatgcaaaagtactgcaaactgggtggcttctcccagaaagagaatgcctaggactatagcggggcacagaaagttccccacaaggagtatttcaaagctgagacattaggggctgtatgaggcagaaaaattggaagcagaggcaaaatgggaaccttagggctgagagagcctgaaggttgtggggcattaaaaattcatgctgtagattaacagtgtggggtgtaaaggatgctaggagaggaagaactgagcatggttagggatagttgaaggtaaagaaaaaacgggacacaggcccagcttccttgacaacattatctcttacctcataaataaaatttatgctatgaggagtgactttcctattcgtctttcctattccccaaataaaagcataggcacacaatggctttgctgtatttgcatgtattcttctcatctttcttctaagaatgacatgtccatctttctaccattccctctttgtttaactttagatcctggatccaggtcaattgatcataaatcatgttgcctggatggccaattaactgaaagaatattttaccatgttttcttatttcttgtaactaattataaattttagaacaatttgtgttggaaatcttctaaagatttctgcaaagttttagtagatttagttttgtcttcataacaccacttggaggaataattctttgcacttgtgccagctgcctgttttaggatagatagagtagagaaactctccctacgggaaagtcagagcaggaggctgcctagagcacatcttcttgtgggcctcagctcatggggtatgtggaagactgagactaatgggtagaaagagagagcctataagtgtatttttcttagactacatcagctgagaatacactaatgaagaaatatttttatatgtaatattttggttattttctcaaatatattatttaatataaatataacatgtaaatatatgaatatacacaaatatatgcatacacacactcacacacagacacatactctttttaggctcctaagtctcacactttgcttgtgagtttcttcctgattctgagatcactatctcagactacttcgtgtgctaattctcctctccatgttttatttatcagccatatcctcactctgtcccagtttcctccaagcaaccaccaaggagcagcagaaaacataaatcaaacattctttaaaactctatcaagacagagtgaaaactgaatagttaaaagaaaaaacacattgggaaaatggtcatttgatgattaaaattgctccaattttatttttttagaactattgaaataaacaattattgaaataaattttgttattaaaaatataacaaaaaacttggagtcggtagtttttctgctttattctgtctccactctcttgggcttatttgtctcagtaagttctgaaaaaatatttgccaaacaaataaaataataccatgtggattaaggttgatagctacatttgccttgaaaggtcacctaattcaaagtagattggtctttgaacctggttttcttagaagattttccctgaggcaataaaattctgagagtgaactatgatactattgatatatgtgaatgacacagaacctacaagtaggaagtcttcgatgagtcctcatttggagattttctagaacagacattaatttaactttagagagaacccaaacagatagcctggagcttggagctataacaggtgggatgtgagagtgaggaatcttccttttggcattgcaaatactctggaaattgcaatcagaagcagatgacaatcaaatttagggctgatgagataatatatctatggagttataaactagagagaaatttgacttgggaagggacttctggagaaagccatgagttcgatcagtaaataggctggccaaagtattcactttgacttaagtcctacagtgtccatggagataactatgattatttttgttattaatgtggaattagcaaactagagattgatctgtaaaagtttcaaagggcagtgacataaatatctttttaaccttaacatcttcaaaggaatatcacttaaatacttgtcaggtattgcttggtaaacagagacttcttatattatgcacatgtgtgtatttgcaggtttagagcagtttgtcggaagaatgcaagattttcgattataccaagtggcacttacaaacaggtaagcagatgttgcattgtaaacctcaagaaccgaaaggataaatgctgaattcacttaaataagaatactatgtagattataccattttttatctttataccatttggcaaacttcacctaattaatgtttacagtgtttgctttggcttagtctatggttgttattcactagtgctactcttgaggaactccttgtaatatgaaattgatcacatttttcctaaggatattctgtaagaaaacttgatatttgaacattttataaaacttgggatacaatgcttaaattttctatatgaggtagtttctattaacaatacttgagaaacttctacatctgccttttttaaattggtttgttgactttatacctactagagaatgtagaacaataaacgtgattaattattttgatacatgggaaattctcaagagactgatctattagacttggagacaagaagaatgagcatttgaagtattgtgatatatttttctattttcagtgaacaaataattatatagactcaggctagctttaatgacattatttccttatcttgagagtagatgggaaatctttcttagggcttcttaaaagcacacagaattttaaaaaatttaagtgaaattctgcttaggatgcctttgaactttcttcttcagcttatgatatcatggtataatagtatattgttgtatggatgagttgatcttatttacttctattaaaaatcaaaaagaagaatgttcattcatatttcttcaaggcagatataaattagtgtggtgggtttccaaatgagaagactagcccttgtaaatttagaagcattgcttttgatgtggttcttagtccatggcagatcattaacaatataaacattctttcttaccaggctatataatcaaggtatgcctcagtaaagggtgccatggccctggaacacagtgttaggtgtatttactgccaaaagccttactatattttagatcacctttgtctaaaatgctgaagggcaatgttgtagtaattctttgggaataaagtttttccttgggagtgaaagattttatactggattctatactggtagcttttggtcccattcaaaacttggtatcagttgaaaagaattgatgagatttaaagaaggtatgacttcatgtgatttaatgaatggaaaagctgcctgactccttcactgctccactggggtctgagaggaaaagcctggtttctctggtaagaccttgattactaattttggcctacctgaaatgtctgggaaggtgctatgtggaagaatgcctataaatagaatgactaattctggtctagaacaagtatattgcccctaatggaaaaattaaatatatctacctggaattggcattctttgactgttggcagccgccatatgatctgaagccaatgaagcattacaggatgtcaggatctgtactgatgagtcacaggaaaccattgacaaatggccttggcctcagtccttcacttaaaacagaagcagataaaatgatacttgctttcgtacttctttcccatggatgaactgaaaacattatctataactctcattgttctccatatattattgttcactctcagtagttagtttagcatcctaagtaaatgtgatcatttctatattatcacaaatagacacggtaaaatattgtggtatttaaataagtatcttaataatcagacaagggcttatgcatgcttcttgatataaataaaaagttaatattaaaatgtgtgggttttgatatacattttatgataatgaatttgtttatttggccaaaaataagttttattttatgtttcatgcatcaaattattaaaactaaatggatactcatgaaagcactaaacgagtgacattcatttgtaacgactcctagaagttctattactgttaagctctttgtccttacagtctccctcttgactcccacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtaatgagaaacgataaggtgtacattaatttcctgtggttattgcaacaaatgcccacaaacttcatgtcttaaaacaacagaaatatattccctaacagttctggagatcagaaatatgaaatcaacatgttggcagggctacattcccttaaagattccagaggaggatccctccttgccatttgcagctcctggtggcccttggtgttacttggcttgtggcaccacaacttcaatctctgcctccattttcacatggtgtccttccttgtttctctgtgagcatcaattatcccttttctttctcttatataaggcccaccctattagacccaggatgatctcatattgacatccttaattatactgcaaagaccctatttacaaataaagtcacatttacaggtttggacagtagtacttggacatatctatttgggaacacaattcaacccactacaaggtgaaaactgaactaggcaattgaaccttgcctcaataaagtagtgtattataatgtatacaataaaaatatctaaaagacaacatgtaggaccttatgtttgagatttgtatcaaaatgatatttatgaaatgttgaaaataattatttttattaagtagcaaaaattaatacaaactaaggtgctttttctaaattaagaagtctctatatatgacatttatttcatagaagtaatgttctttgtttatgtctttatttgcatgttgatttataaaatccttgagcaaatgaacagatacacaattatagaatatgttgcttttaccacagggctatgaagtttctggatgtctaatacatatttgataactataattatgatgaagtgagccaatatatttgaatctaataattccatggtttgatatatactgatggttaaacttaaaactttaattacattaattaactttccattttcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaagtatgaatatttttaaacaattaatttaatagactgattggttattaataatgtacaagtatgctagctctctaggctggtggagacttcccttcaccaccaacttccttgaggcagattctcctaagtcttatccctaaattgggcttaaaactatgtttaaagttcttgtaaaagacattagagtgactcttatttcaatctcactgatgtttcacaatctgattttcagattgtttggcaagttatctatgtaaatagaattttcattatgttttcaaggaactgttttagtgtggctttctatgataatcctgtattgtttatatatgaaatatatggaatatgcttttcctagaatgaataatttaagcttttattgatactgtgtagtaatttctcaacattttgatttctgttttgccaaaaatgtgaatagattttcatgacatcgaatttctttcattaacagttttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggaggtattattatgaattttgttttcaacaaggtttttgtcatacttactgtcttaacagcacattaagatgtcagagcaagccagatttcaagctttacattttgaaatgatttcatactctaagattttaggggaagatctgtatgtgagtcttttctctatataacattgttatatatatatatatatatatatataaaacgtattttataaataaatatatatatatttatatatacaggaattgattttcaaaagctgttgcttttagaagctatgatactctgaatctgacttagaagtgatttatccaatattttacttgatttgttctggaatataattttcaaatattctcaaaagcaaagagatggagctgaatttggagttgtaactatagcaccagagagtttttaagtacagatcttgatctacctgagttcatagtgcacagttccatgggtaatacttgtttttctttagtggaaagatctgatatgccctaagtagtttataaatgtctgatcataattgagaacatgactcacaatatttaaaaagaaatgacagctgcaaacctaggcagcatactgtctaatatagaaatgtacatatagagtatatttagaatggattgttctggaggaatgataggccttgtgaataaaatatgtctttaaaagcagaccaaaataccagtatataagcattgtttgtttgctaagtcatagcataatgaacaaagcaatactattaaatattcatcatctaactttggaaaaaaaaataaaaaaattgaaatatgttaactgcattctgcagtttattgtcaactttatattcttttttctttcttttttttttttttttgacaggcttttgctctgtcacccaggctggcatgcaatggcatgatcatggctcgttgcaacctcgacttctgggcctcaagtgatcctctcatctcagcctccaaagtaactgggactacaggcatgtgccaccatgcccagctgattttttttttcactttttgtagagatggggttttgccatgttgctcaggctgctctcaaactcctgacctcaagtgatctacccgcctgagtctcccaacatgctgagattacaggcgtgagccaccgtgctcagcctgaactttatattcttaactgtattttaaatagtgtagtaaatgccttcccttggtacgtggttggtatagatataaaaaattccatttccctttagaggttggcttgaaaattatctttacaatacacgggtttggatattggtgacagtccttctgacatttccagataaattaaaaacgtgtatggatatccacacgattaaggagaaactgattttgtatcaattaaatatacaaaaatcttccctgttaaattcacataatgcatatagtcctaggaccttaaatatattcacagttgagttggtgttccttaggagtgtgtgatgctcatgtttgcagatgtcagtgccatggtcatgccgataactgcgacacaacaagccagccatatagatgcctctgctcccaggagagcttcactgaaggacttcatgtgagttctattttatgcatggaaatctaaaaaaaaaatagtagagatggtgactataaattctatgaacttaatcttggcctaacaaatgaaaataaatttaaaaactgatatgaacttaaaatgtcaattattgcagattttttaagaaaaataacagccatcaattaagttgaaattgtagtttttaaaaataatttcagccagagaaattacaactgaaaccaaaccctaaggttcttttctcttttgtttttctttctttgtttcatcagcattatcatgttttataaaacaatttttaatgtgtttggatagcatggcactaaacaaaaaatagtttgattcttactaaagggtatttatacaaaagtatcaataaacaaaagcatcgttagatgaagaacaatgtttatgtatttatgtcaatcaaggttcatttattgctaatatcaggcattttaattaattgaaaatctatagtaaaatgatttatgagttatgttactttagttttctgtgacgatcaggggaattccatagttgaggtggaattttagcttcatctttagggaaaagaggtaagtggaaataaaatcaagaaacattcgttggtaggaatatctagcaacaacatcagaaatagctgatatgaaagacggttcagcagcagtaacaattataccaataatgagagtagataatatagactcttcagtaaatatgtttaagacaactggctgctaatttgcaagaaaataaaattagagctctactgattgtatgtacaaaaatgtatgtggcttaaacttttagtgaaaaataactataaatatattaaaataaagattagaattctatatcttaagttgagggcttttatcagctaagcaaatgaaatacaaacagaaacaaacatctggagctatgaaggaaattaatgacatattctgttatataaatatttaaaattctacacagtataagggttaacataaatgtaaggtagtgataaatgatggattgatagaaaatatttgcatcatgttaacaggtaaagagttaagattcctaacacacaaacatttacaaaatattaagaaaaatataacagtctgataaaaatgagcaaatatatgaacaagcaatttacaaatgaacaaattgtaactttaataaacatataaaagattacccaacctcagttttaatcatattcaacaattgtttttaacatttcaaattagcagaaaatataaagattggtaatatttagtacttgtgggaatataacctttaacacatcactgatgggattgccaattgacacaatagttttggggaaaatttgtccacctctactaaaattaaattttcaaatatagtgaactacattatataattgctgtcattctgaaaagcagttcttcaatgacaagtgtatggaatggtgtattagtctgtttgcattgctgtacaggaagacctgagactaggtaaatataaagaaaagaggtttatttggcttgtggtactgcaggctatacaagcttggtgccagcatctgcttggtttctggtgaggcctcagaaagcttacaatcatggcagaaggcaaagccagaagccagcctcttttaaacagccgtgtctaaacagccatgaactaacagagtgaggtctcactgctgaagggaaggcacttcatgaaggatccacctccataacccaaacatctcccaccaggctcacctccaacactggggatcacatttcaacatgagatttggaggggacaaacatacaaactatataaaatgcttatatttctatcattttgttacataaatatgggcttatatgttagtgcattttagcttttcagatggtagcactgtctcatacactcatgtatgacttgtgaacatctctgcctcttggaccttgccctacacttgtgttttagttagttacttcacttctctgtgaaatttattttaggatattatagagcatcttgctttttaaaaaaccatctgtaaaggttttggcaaattccatttctgtcttctgattcttactctgatctaatttgcttttgactgtaacattagtgagaatagttcaatggtaagaatattatctataatgcagactttctctagcacattcaaaacgtagtcccactcctcagtttcaactaagagtctttgatttagttatggcctactttctttctttctttctatgtgctcagaccaaaactttcatgttctaatttagatattcttttgaatttattttctagatcactactttatatacatctagtcctcaccattagtcaatacttgctttaaaagaagaaatcttttatggttttcttttggatttctaatgcctagagtctttgcatttgatttcattagtatattatgaggaaaaatcttttagaagaactgattttaatatgcttgattgtatggcttatcatattgtcacagaaatgaaattaattggattaacttgattgatttattcttcactgagccataattgtgtgtttaaatttttgccaattttatttgttctagattttaaagttaaagcaacatttattatatttttctactgtcttcttttgatcccttaagatggacacttacttccttataatcagtgatttctttcattaaccttgtcctctcctccacaaagccactaacaccccaattaaaaaatgctttgggatgaatttagcagggcaccttgaactgaatatgtctagtatttgcaagctacagtttggctaataccttcatatgatatgttcttttctgagcttctcttgctttctgttgactagtcagtcggtattagtctctctcatttgcttgtgacgtcctgtcttgttttatctttctgtctttaattgctcacagttaagtgttggatattttctgattcttggatgatttcatgcttccccttaaaaatagagccattaaatgaatgaaggctcatgattggtttcagaagacaagttgggattttcagacttggtctcaggtggtgaatgttggattatgaactagtgaattaattaactataatttgggttgagaatacattttaatgcttcttatttagaccttaagtaccttttgaaaacaaaaatgaaaaactaaactttttttgttattttcctccttgacatattttgatagtttatgaatttagccataaattttaaaaagcaacaaatataatttacttagcaaactttggcaaatgcaaatgcagctgcagggaaaaagtcaatagactgttaagttgaatgatttctcagtcctatgatattttcaataatgtgttgaaaatgaaaaatgattttatagaaacattcataggcatgacattctcctttgttaccattcaaagtattttaatacaagtagagacttacatatctgagaaaagtcgtcttacggtaatttgaaaatatacctattctaatgcttttcttgttgttctactttttaaaattatacgttttaatataagccattcacttcctattgggatccatgttctttttaagacctggacataatccaaaaagaatgtcttcaattccacagtgttatgctatccattaataatattacttaataaacagggcttttgtgaattatattacagacatttggcaaacagatgaaaatgtaaggactgaaaatatgccaattcttggcaattgtctttcctatgagaaagtgtttttagtagaaacaaaaatgaatgaagttgagaaaaggtgaatggtgaattcaggggcaggttcacatatttagccatcctaaggaattttccgtacaaaatactattcatttgtttataaggtcaatgtcacaaattggtggctcacaggtagaaacagtgtttaaacagttttaatttaattttctgcaagagttttcactttaaaatatttatttattcttcaatcttttttatttatttatttttttgagagggagtctcactctgtcaccgaggctggagtgcagtggcatgatcttggctcactgcaacctcagcctctcagcttcaagcaattcttctgcctcagtctcccaagtagctgggactacagctgcacaccaccacacgcggctaactttttgtatttttttttttgtagagatgggtttcaccttgttggccaggcaggtcttgaactcctgacctcaagtgctccacctgcctcggactcccaaagtgctgggattacaggcatgagccaccactcctggccctcaacttttattttaagttcagaggaacatgtgtaggatgtgcaggtttgttacttaggtaaaggtgtgccatggtggcttgttgcatagatcatcccctcacctaggtattaagtccagaaaccattagctattcctcctgatgctcttccccccacagcccccaccatccctaagaggccccaatgtgtgttgttccccgacatgtgtccatgtgttctcataattcggatcccacttgtaagtgagaatacgtaatgtttgattttttgtaccggcattattttgctgagaataatgacttccaactctattcatgtccctgcaaatgatttatatttctggtaatacacagtaatgggattgctgggtcaaatggtatttctgcctctagatctttgaggaatttccacactgtcttccacaatggttgaactatttatactcccaccaacagtgtaaaggtgttcccttttctccacaaccttggagcttctgcacagcaaaagaaactatggtcagagtgaacagacaacctatagaaggggagaatatttttgcattctatccatctgacaaaggtataatatccagagtctagaaggaacttaaacaaatttacaagaagaaaacaaccccattaaaaactgggcaaagaaccctgagttagcgagttgttgccaggggaggacattaatgtcttcttttgagaactgtctgttcatgttcattgcccaatttttaatggggttgtttgtttgagaacagttctcaaaagaagacatatgtgtggccaacaaacgtatgaaaaaaagctcagcatcactgatcattagagaaatgcatatcaaaaccacaatgagataccagctcatgccagtcagaatggcgattattaaaagttaaaaaatgacacaaatttttaattcctcacttctcttaatcagaacatagtctaacactgtgtccatttcctgccatcaacaactcactgattcagggtgacatttaccacatttacaacagtatcactcttgggcttgctacaacattcactactatgtatatccttatacatgggcgacatcactttggtgaactacctggccttgaaagactcggagcttcttaacctcctaaagcaaaactgatggatagattgagacactagaagctagaatacatttttaattattctgagtagagaaagaccagctgttcattgctatattcattgttaactcctatttcttttacccctttataaaaataaaaactcacaaataaccgaaaacaactcaagaaaatctattagcaaagacactgtttactctgagatgaaattaaagccatgcttactttttttttaattacatttttgacatctaaaaacatttaccttggggagcctcactgattctcctctgcactctttgaccaggaactccgatacatttttgtattgtactggcaattttaaggccttgactttaatgtatgatacataccataaatacttcactcatagagaatacttttagaatacttgtcgcatttctttccaagaatgaaaaaaaagcagtaaatgcttaatttactaggctcactttagaactgatttagggtgaaacaaatccaaaagcctagatgctattcattaactttcatacaaagttaaatatttcaaagtagaaattagaaatacatggtattgaacttgcatgaatcattatatatctcacaagttacaaacatgttatttataaatgtttaatttcatttgaataaaaaatagccactgttacttgcatttttaagtaaacttttaattttgagataattatagatttatatacagttgtaaaaaataatataaagacaatttgtgtactctaccaatttgtcccatggtaacatctggcaaaactagtgtttttttctttttacatcaaaagtgtgatttgtgtacaataaaatatacccacttaaaaatatatagtttgatgagttttggcatatgtgtaccctgtgtaatcaccatccctgtctagagatggaatgtttcactctcccaaacgttctcttatgcttctttgcagtcagtgctgtctctgaacccccaatcccaggaaaccaccaatcttatttctatcaatacagattagttttgcctgttccaaaatttcttagcatagtgttatttggtatgtaatattttcgtacataggcttttaaatcccacctcacccccacttttagatcattccctaattacatgtgctgttagctttactgcaacatggtatctctggcccacttaatcagaaatccattataagtatcaaagtgtatatattaagctcataggtacataatacaagctaggaattggaagcctgggtttatctgtcaactaacatatttgcaaagctataatatatttattacttctttttcttatctagtactttctttacttgatctaagagttcaagtgttgaatagaatctagttttaagaaaagtgttgtcagttgaaacttgaatccttatgagttgtctttttcctttaataactacatttacctttcggggctctggccaagagtgatgcaatgatcagtgtctcagccaagcattggcacttcattggctacttagctattctttcgtcattttgtgacatcattacctgcaagggtagccaagccttcacagagcaatttattagtaaccatgaacacttcttattctttggctctaacttatgacccttttataacattaatcatagatcttatgaattaactacaatcaaactatcagtataaatttttgttagcattataaatagcacagccagcttgaaactttttatataataagccttcctaccactcaataatttgaatggtgccaacatcacactctagaatgcttattatataaatgaatatttctgttatttttgaaagattcctttagagcaccaaagtccaaaagtatgaatcatcatgactaatttgtgtcatatttatattatatatcaggctttaccactgcttattttttctctgtttgttcgcagattttaccctaaatatattttatttatattttaattattgtaatgctagtaaattaattcatttttatataactagcattcacacagttcatattataggatctacatttgatatatgtttagtaagtcaaggtaaagaattttctttcctcactgacatgatgatattattaatctttgaaaaacacttgtactagttctttccgtgagataggtatgtgcataaatgcttttaaaatataagttgaaaacatgaaaaagaggttatgagcatggagataaattaagacagccttacagaagaagcaaatagagatagtgaaagtataaacatagtaaaagaaaagataatatttgaagggataagagtaaagaattatctaaaggtgaggaatgacatgatttttctgaatcccaagtaggctaagaaaagtaaatgcatacataggtataatataatgaatccaataatcaccaaagaccaagcagccagaaagacagaaatctgataatcaccaaagacagaacagcatcctaaaaacagccagagagaaaaatacaaagtgtaagaaattaatttctaagacactactgatatatttctcaacagccacaatgaaagccagaagacagcagagtagtgcctttgaaatgcagagagaaggcaaccaagaaatatggaattgtatttgtagtagtaccatcaattagaaacaagaaagaaagaatgcatttttagtttacagatatatatatcaatattatcaccagcagactctcaataaaagaatttttcgagaatacttttcataaggatatataatgtttccagaaaataggcctggtgtgaaggaaggaattgtgagcaagtaaaccagcaaatatgtggataaatatagaggaaaatttactgcgttaaataaaaataaggttatatgtaagaaagagtataaaaagtagcaggataccattaaatggtcattaaaaatagcatttaaagggaaggggtaaactccaacttcagctccctctagccattctgttgcaccttggggtaagaagagcagttactgagaaatacttgtaaagttcacagccaatgagcacagggctcattaaaaactgaaaactaatcctagaatcatagaacaggggtccccaacccctgggccactggtcagtagtggtctgtggtctattagaaaccggactgcatagtaggacgtgagcagctggtgagctatcattacttcctgagctctgcctcctgtcagatcagcagtgacatgaagttgtcataggagcataaaccccattgtgaactgtacatgtgagggatttaggttgtgcactccttctgagaattcctgatgctttgaggtggaataccttcatcttgaaaccattccccatgtgctgccctcacacccagttcgtggaaaagttgtcttccacaaaaccgatccctggtgccaaaaatattggggaccactgccatagaacgctttccctcccctctcatcttaccaccacaccatgaaaggcctgtttgccagagttccctttactcagtacatcatgtctggatttcaacaaaaagttacaaagcacactaaaacaccaaaaacaaacaaacaaagaaacaaacaaacaacctcacagtttgaagagagagagcaaaaatgagaatgagactcagacatggaaaggatatggaaattatcagaccagaaacttaaagcggctctgatgaatacactaaaggctctaatggaaaaagtagacaacatgcaaaaatagatggcaatataagctgaaagataaaaattctgacaaagaagcaaaaagaaaagctagagatcagaaacactttcatagaaataaagaatgcctttaattggatcattaatatttggggacagctgataaaagaatctgagtttgaagatgtgtcaatagagactaccaaaatagaaaggtaaaaagaaaaatgactgaacaaatagagcagaatatctaagaactgtgagacagctaccaaaaatgtaaatacatataatggggaagaagaagaagaagagaaaggaacagaagaaatatttggaacaataatgactaagaatttttcatattccaaatgcagaaaaatcaaagttagggaaaaatatcttaaaaggagcctggctgaagggggaacatctagcctatgaaaaagcaaagataagaattacattctacttctcctcagaaagcatgcaagcaagaaaagtggttaaatagttaggtgttgacagaaaaaaaaaaatccacctagaattctgtatcttgcaaaattatcctttaaaagtaaaggaaaaatactttctcaaacaaaaaccagtagacttttcttgccttgcaagaatgttaaaggaagaacttcagagagagagaaaaaatgatacaggtcagaaaactcagatttatgtaaagaaagggagaacattagagaaagaataaataaaataacttttatttttcttatccttaattgatctagtagataccagtttgttcaaaattataataagaacaatgtatttcattattatagcatgtgtgtaagtgaaatgaatgatagcaacaatacaagacaccagagggaggaactaggaatactttattattattaggtactcatgccaccttttaagtggtatcgtgttatttaaaagtcaacttggaactctcgcatgacattattttgtcttgatagttcaagctccacctgcggttctcccgtcctccatgccaggtgtcaggggctgctctggatgttaactcttccgccccatgacttccagttccaaaatggcggcacagaaacaagctgccatgccacaaccccaccgcgcccctctcccgccaaaaagaaaaattaacaaatatacattgctgagattatcaccagaaattgtcacgatagtccagaactcaaatatgaagatataactgttcccagggccataaggaaatgagaaacaccaagtggatggtaagaaacctgactttcacatttgtagcactcgttaccccattttgcctgacaccaaatatgcagaagattttcctccaactcacttttttctacactggaaaaattaagattgaggtaaacaaccagcttccccagccattctgggttaccggaaagagacctgtcctatccatgcctcaacccactggaagcgtcatgagtgcctaaagggagacatattcctgaagataggcagagacaaagggggatgtaggtctgtcatccccagcctgggaaagtctgctctgtaacttgaccaatgcagacacaatgtcagagtagctgcttagcagcactatgatgcaggaggattatttcactgttctcctcggcacaaacccttaggcagccttcccatactgtcaggatattccctttgggacctctcttgttaagaagggcacaattggattgtttactgaagccaaggcgaacctgggcttaaagcgccccctatagctccctagaggaagcaatttagcagcaaagacatagatgtatgtccacaagaaaaacagcagtaggaaactatgatgtctccaaacagacaaagcagggaaccagggactggccctaacaagacagtaatatgtaagctccctgaccacgaattttaaaatgcagttttaagaaaactcagtgatctccagtagaacacagaaaaataattcagaaattcattagagaaatttaacagagattgaaattttaaaaaatctatcagaaaccttggaactgagaaataaatttaccgaactgaaaaattcactagtagctctcaccatcagaatggattgagcagaggaaagaatcagtgagcttgaagacagaatatttgaaaatatatggtcgaggagaaaaaaagaacacaaagaaatgaagatttcctacaatatatagaaaattattaatacctcaaaaggccaaatgtaagaattaatggtattcaagagggagttgaagaggaaggattagaaatcttattcaacaaaataataacaaaaaattccaaaatttaaaagtatacttggattagttataaatgtatattataagctttatagggcaacccccaaaaaagttttaaaaaggtatagttgatatatttaatacttacaaaggaaagaaaatggaaccatgtaaaaatgctcaactaaaaccacaaaaggtaaaaagtatatagaaaacaagaatagaaacaaagaacaagggcaatgaataaaaagtagtagatattaatccaactatgccagtaactactttgagtgtcaatggtctaaatataccaattaaaagagagagattgttagaatgaattgaagaataaaaccagctcattttataatgccaacattaccctgtaccaacatcagacaaagaaattacaagaaaagaaaaccacagaccaataactctcataaaaatagatgcaaaaattctcaacaaaatattcaaaataaaactattaagcaatgtgtaaaaataattatatatcagaaccaagagggatttatctcaggtttgcaagactggttcagcattcaaaaatcagctaaagtaattcctcacatcaacaggctaaaggggaaaaattacaagattatatcaataaatgtagaaaaagtatttgacaaaatcaagcatccattcatgatcaaaactctccacaaataaggagtagaggagaacatactcaacttaatagaaaatatgtataaaaacctagagtgaacatcatacttaaggataagaaaccagaatctttcctactaagatcaggaataagacaagaatgtttcctctcagcactccttttcaacaacgtattaggaaggaataaaaacaacaacctcatttcaaaataaggcagtaaaggagaacgaaagaaaaaggatatatagaaaatagaaattccaaataaataaacaatcacaacaaatctaaatgtgctgaacatattagaattatgagactgtctggctgaaagagaaaacaacatccacctattgtctgagcagaggctgaattagggcaagagaatgtcttaatcacaaactttacaaaagcaccaaaaacaccctattaagcaagatctataatatttttatgttatatttcaaaaagtcaaatgatttagaaatgtataattaaaaatcaaaattttaagtaaagacacattagtgttgcttgttttatggtcctgtgttattttgtaatgggagctgttgtttctaatcagtccataattcctacctaccagttttataaggttggcatgtacctgtctcatagaaggttttacaatcgtctagaaacagactaggcatgatgggacattatacacagctatttttttaaaactgtagagtgtttattaactttttccatttggctccaaagattggtaaatattttctagttgtatacagaggttcgtatttttcctttgccctcatgctgcaatgcagctcagcatggtacttgtgctgagggtgtgagagacatactcaaaaaacaagcacacttcaagtttgaaaatttaagaaagctagcatgagctacataaatattaggcaaaacagacattactgtttcattaaagaaaaagaggcttattgtataattataaagtataaaattctaagtttacatgcatctcataatatagtttcaaaagtataaagcagaattttatagaaccagaaagagaaattggcaagttctaccatcagcatagaagaatttaatacatctcttattaaaaatgtctttttataaaaagaaagaaaagctacatactagcagttgtcattagcaagacaacacatatataactgacaaaggtaacatttaaattaagcaaactatttgaaaaacagacaaaagaagtgaacaagtaattcacagaagaagccagaagtggcaactgaaatggtcaatatacatgtaaagacatgtgcaactttactggttatcagtaaactaaaaaaaaagaatgtgataatattttatactcatcaagttgtcaaagatggcaaaatctggaaatttcaggaactggtaagtggggactcatacaccacttatgggaaggtgctgctgcactatggaaaacaatttgcaaatgtctacgtggaacactttacagtagtggatatgaaggaatatagctatcacatcaacatgaccagacttctcaaacaatcatactacagaaagcttgttttagaataatacatacactgtatacacttatataaattttaaaatcatacaaatagaaagaagaaactgataaaaggataggaggcaggactaacttgcagctccccctcggacagacagagcagcatgtgaagacacacatcatgaacttttctccaagaactactgcagcaacataccaggaaagccacgagaatccacagatcctttgaaggaaatagattgctgctgcaggctccaggagacagccgaaaaactgtaagtgcccaaagtgtgaaagggggatcttccacccctgaacacatagccttcctggggaacctgaaggtccaggtcacaggtgatggatttggccttacctggagctgagacaaacttagagagctgaacaaaatataagggtaaaggaagcagggggaagagccctgtggactctctcagcccccaggaaaaccatttctgactttgtctcctagggtccttgggtaggactgccagtggaagtggggaaagaccacaaggagaaggaaacttccagatgaactctgtaacaatttcgactgaatgccaactttcctagcagaatctgggggtgagggtgaactgggagtgcagacacagcacagaagttgcatcaggcagggaggtgtgaaacctgaaacccctgcttgcttttccagtggggagacctggagcaggggcaagtcctcagccctgttcacccattgcctggaaataaactcagtgctgttgtggagagtattgtgggagtgagactggccttttgggttgcatgggagctgggtgaggcctttcactgccagctttcccctactttcctggtgacctgtatgatgtagcagaggcagccataatccccctagaaacataactccatcgccctgagaaccacacccccaacactcagagcagcttcagcaaggcctgcccaaggagagtctaagctcagacacacctaaccctgaccctacctgatggcctttctctacctgccctcgtagccagacaaaggacataatctcttgagagctctatggccctgaccaccgcctgagaaacttatccaggagactctagagcaagcttgtatcctccctatgctactgccgttgatgctctcttgaaagcgccacctcctgtctgaaggccaaccaacacaaaactagtgcaataaacaaaaatacaacaaaggaccctcacagagtctacttcactcccctgctatctccaccagagcaggtgctggtatccagggctaagagacctgaagactgatcatatcacagggctgtttgcagttactccccactaccagtctggaggctgctagctccactgggtggctagatccagaagagaaacaacaatcactgcagttcagctctcaggaaggcacatcctggagcacccacatccagggagcacccacatctagggaacacccacatctggggagcaccctgtgggaagaaagaatctgaacaacagcacttgagccccagatcttccctctgacatagtctaaccaaatgaaaagcaacctgaaaaacagttctagtaatatgacaaaacaaggttctttattatccccaaaagatcacaatagcttaccagcaatggatctaaaccaagaagaaaactctgaattcccagaaaaagaactcagaaggttgattattaagtgactgaaggaggcaccaaaggtgaatatgaactcaaaggaatttcaaaaatgttacaggatatgaacagaaaaatctccagataaataaatagcataaataagaagcaatcataatttctggaaattaaggacacacttagaaaaatgcaaaatacactggaaagtcttagcaatagaatccaacaagtagaaggaagaacaccagagcttgaagacaaggcttttgaattaacccaatcaaacaaagacaaagaaaaaaaaaaattaaatgaacaaggcctccaagaagtttgggattatgttaaacgaccaaatctaagaataattggtgttcccaaggaagaagagaaatctaaacgtttggaaaatctatttgagggaataatcaaggaaaacgtccccaaccttgctagagatctagatatccaaatacaagaagctgaaagaacacctgggaaattcatcacaaaaaggtcattgccaaggcacatagtcatcaagttatctaaagtcaagatgaaggaaggaatcttaagagctgtgaggcaaaagcatcaggtaacctatgaaggaaaacctgtcagattaacagcagatttctcagcagaaaccctgcaagctagaaggaattggtgtcctatccttatcctccttaaacaaaacagttattggccaggaattttgtatccagtgaaattaagcttcctaaatgaaggaaaaatacagtctttttccgacaaacaaatgtttagagaacttatcaccaccaagctagcactacaagaactgctaaaagcagctctaaattttgaaacaaatccttgaaatacaccagaatacaacctccttaaagcataaatctcacaggacctataaaaaaaaaacacaatttaaaaaaaagcattcaggcaacaaatagcatgatgaatagaaaggcatctcacatcctaacactaacattgaatgtaaatggcctaaatgcaccacttaaaagatacagaatggcagaaaggataagaactcaccaagcaagtatctgctgtcctcaagagactcatctaacacataaggactcacataaacttaaggtaaagaggtggaaaaagatattccacgaaaatggacaccaaaagcaaacagcagtagctattcttatatcagacaaaacaaacttcaaagcaacagcagttaacaaagagggacattatataatgataaaaggactagtccaacagggaaacatcacaattctaaatatatatgcacctaactccagagctcccagatttagaaaacaattactactaaacctaagaaatgagataaacagcaacacaataatggtgggggacttcagtactccactgacagcactagacagatcatcaagacagaaagtcaacaaagaaacagtggacttaaactatgacttagaacaaatgtacttaacagatatttacagaacattctacccaacaactgcagaatatacattattcatcagcaggtgaaacatcctccaagatacaccatgtgataggccacaaaacaagtctcaatacatttaagaaaactgaaattatatcaagtactctctcagaccaccgtgaaataaaattggaaatcgactcaaaaaggaaccctcaaaaccatgcaaatacatagaaattaaataacctgcttctcaatgattcttgggtcaacaatgaaatcaagatggaaattaaaaaagtcctttaactgaattgtttgatatagtgacacaacctatcaaaacctccatgatacagcaaaggtggtgctaacaggaaagttcatagcattaaatgcctatatcaaaaagtctgaaagagcacaaatagacaatctaaggtcacacctcaaggaactagagaaacaaaaaccaaacccactcttattgacttaataaggaaattaaaaaaagtatgctgagattgctaagatctattataataatgaatcttctatctgtgaaatagtgaaaaaaaaagaaattagtgctagatttgctgtcaaaccacaaagtgcaaaagttacggccgcagtgctagataagtgcctagttcagattgaaaaagcattaaatttgtgactggaagacatgaacagaaaatatgtactatatggaaccaaaatatgtactacatagtacacatagtaccaaacccagttgctgtcacttggcacatagagatctggcatctactggaggtcttcaaatgtattccttgtggaaaacaggactacttactatactactaaattcagatattattagcggagtggaatatatatggcagtatcttgtttctaagttgagtggtacataaaatggtacaattctttttttaattattcataaatttatttttaatatttcagtataatttcccttaaacacaataatatgattgattaatctatcaggaatgtatcacctatgtaaatactcatgctactactaaagacagagtggaggtgactctattcacaatggaataaccattactaaattcatgattactgtgtacatttatagttttactgtaaagattgatcatttgctagctttagtcactcaacaaatatttataaatgccttctatgtgtagtgcattatgctagagtacagccattatgtcttgattacagatgcaagtatttgaaaatattgaaggaccttcatttgtgaaattcaaaaaagattccctggcagacaccaattactataataaatagagatgacttcagtgcaaacaaatgattcaggctaacaattagtaattaacaaataatataaatagtatagacattttaaatcttaaagaaaaatttaaatgcagcaatacttaagaaagggttttttaatttactaatgtagtaatcaagtctaatactacaaaaaatttctaatatgaaataccctttatatttaaataatcaaataccttgtataccagttgactaagtttagaggaatcttaaatattaaaaaacatcaataacgccttatacttcttagtatgtgaattcgtatttgtatgatgtatattattttggagagttgcctgtaagcaccatattaatataatgaatgaagcttttcttcattgaagtcctttgtaaaataatgcaggttatcctgaataaatatggtctctattccaggccatatttcctggaatatcaatagggttaaattattatggttgcaataaaatagaattgctttatcttgtccactatctacaatcttgaataaactttaaaatcctccttctgttctcttaagggaacgtggtgtgtccccatgtgtcttttttatttagtgccctgaacaatccataaataagaggaagaaggaataaagaaggacagagatttcaaaggagaaatcaaatacctaacaacatgcagtattgaaaattaacaaataagaatgcaaggcctctcatgcaaatggttccatctcattcaaccactagacataattacttctgtattcacaaggcctacagtaaggaaatactgtttaaaaaaataggctatcaattatatttatatatagacaacatgtagactgaaggattatccgaataatcctgcctagagtttctgtttttctaaatataggttttatgtcacgtattacaatttgtttcattggataattttccaatcttccatttcactttacccatagaattagactaggcattacttgaattagaatgtttctaaaaatagccacttatattaatagttgaaatattgaagtaactatgtatgatgtgtttgtcgtcattgtattgtcacctatgtttgatcagtattgtccaacagtattagtagttatttattttatgctattaatttcagtatctagagagtgagtaagtacattgtatctgtgaacactttaattatgtaagaatttctagccaagggaaagataattactgaaaaagggatatgtcattgaaggataaacacgtggcatttctgtcttctcagtggtaaagaatagtatttgttttggcttttccaattgaaattacataatctgtaggtaaaaattcacaggtgaagtattattgcatttgcctttaaacctttaatgttactattcaattaaatgctagtcacattaaagtacagtcctgtaatgtgtcataaatgcaatgagtctgttaggacattcactcacacattcaccaaatatatatgatcacctcccatgtgcaaagcacagagccattttctgtctagattctctatgtagttgggcactttatctgtgttcccctctgaaatctatcactgataataaattaacaagtttgtctaacattacctttgccatgggaacattagagctacctagggacacttccattggaaaaaagatacctgagtacactaaagtttttatgtttataaagatgatttctctacctagtagacaaatcacagtgaaactggatcctttgaattaccatggaattgctccagccagaggaaaggggaagccttgaatagagccggaggacaattactattattagagatttaggctcttaacatttccaacatagggggctggtttctactgatgagaaagggaaaatgtacagattttcagagggtctgcaattcattcaggccatctgggaatagttaaaaaaattacctcttttattcagtgagcagtactgtaacagtactaaaaagtgatcattttataatctttcactttgaagcagattgtctttctctccttctcacataggcagtgctgcatccatatctctaaattttatagccaggagtggaataactacatcttttggtttctagggctttgctgtccagtttagactcagcagaaagtaaagatggactgagccagagtgactccagtcaacacctctctccctcgaatactattttcggtccctgaagccagtataaacatggagattagaagtgaggtctttgaaggaaaacatccagatatataaattgagtacctactatgttctagggctccttctaggcacttcttcaacatattgaagacaagttgttttcgatgactcattgtgatcattatgaacttaagcttccaaaggtcattgacactgggagctctcaggaccttgaagggaaattttctccctagcccccagccttttgcaaggacttcatatatctttgtctaagaggatatttttcttccttcttttttcaaagatacatagtaggcatttaagattgttgtataagtgactgaataaataaattgctcttgcagttaaattacttaaacttgtattttacacaagtttctactttctctgtaaatttgaaggtgttaagaaataagtaaaattgagtgtgtggcttgtcatggtggctcccgcctgtaatcccagaactttggtaggccgaggtgggcggatcacttgaagtcaggagtttgagacgagcctgggcaacaaggtgaaaccctgtctctaccaaaaaatacaaaaattagctgggcatggtgatgtgtgcctgtagtaccagatactcgggaggctgaggcatgagaatctcttgaacgtgggtggtggaggtttcagtgagcccagatagtgcctgggctccaacctgggcaacagagcaagactctgtcctttatctccaaaaaaaaaaaaaaaaaaacattgagtctatcaggagtggagttgataaaaatgctttggagactatgggttatctttgaaagattgtctttgctgctctgtaatggtaacgaagaaacactatacttcagtttaatgatccataagaaataactgtcattgtgtattattagaatataatgtaataaaataaatttcatcagtgtcttctagattcaatgactattcaatgattttcatacctgaacatgtcaaagtatttggctgcaacttagcggagttgattagtagcctttaagaagctatcaaaatgaaagcagttaaatgaatcagtggtaaaggtccttgaccctgatatagccattgtctaatctcataatttgggcattcagggacatatcgggggaatccagttgttacagaagaaaccgaaacataattgaaagtgacaaatgatcaactggagattgggaaaacatgaaatagaaaaccatttgcttcaggagctgcctaaaatataagatacacacagagttcttgattttaaatcaaactttaaaatcactggtagaaaaggcagttgaaaattatgagaattcaaaaatttacttataatgcacttaccaattattatttcttccattttgtcatggttatccttgtattatctgaaacgagttgttaagaaccaattatgggaccaagaatttaatacttcatgaaactttataatcaaagaatagactacaaagtattccttctgtctttgcaaaccatacaaaatgataatagaacagtatcatctttaggatcaaagacccaaataggcattggtgtgtcatttagttgcatatgtcttaaatcaaattttaaaacaaatttaggcatcatctctcaaaatctttgcttctgtatattaatcccattgttttggaaaaaatgtatattttttacaaatcatactctgtttactggtggctcaaaaactttttagcttacatagtagttgaaaagagaatcattttttctgcagatttttgctcatctgtgtgtaatttaaaactgaaacatattaattttcttaggttttcttagtgaaatgttacatgcaaatgatgtataattatcttgtaactatccatgcagttacattttatttgctctcaatttttaatacattagtaataaatgtacactgtggaaaaaataaagttataaactttatctgtaaacctaccacccaccggtaaccccagccaataatcttagtttatatactttcaggcattatattattgttattattagtaaacctgtctcatctgtctctatcttcttaaaattgcatatttatatctatagataagtccacctttatctagaatagaggattatactctgtatattatttttaacttgattttcaattcaagctgtattatgaatatatttctctatttatatttataaatgttagcctttttttttttaggaattggaacatcttaaaccactctcttgcttttgggcatttaatttgtttccttctcttcagtattatcaacaccccattattaaaacagaaaatctttatcaagcagctttaaaaacatattctcggacaggcacggtggctcacgcctgtaaacctagcactttgggaggccgaggcgggtggatcacgaggtcaggagatggagaccatcctggctaacatggtgaaaccccgtctctactaaaaatacaaaacaaattagccgggcgtggtggcaggtgcctgtagttccagctactcgggaggttgaggcaggagaatggtgtgaacctgggaggtggagcttgcagtgagccaagattgcgccactgcactccagcctgggcgacagagtgagactccgtctcaaaaaaaaaaaaaaagtattctcctaaattctcagtggaatttctgggtcctgtggaatgtatacatatgttgctcctcctaaaaggagtggataaactcctctcctacaagcagtgttctgcactggccctttctacaaattcctttcaccctggtattatcataatctaaaaaataataatttgagaatcaaaaaataacagctatgcttgttttcttcaggaaaacagaacaggttatccatatatctgcagggtttttttctccacaaaagaaaggccagccattttcaataacaagtagtttggcaggaccagaaccattccattgggtcactggtaaaatttgtctttggctttaaacattaaggcagccaggactgtgtctttggacattgatacagcatttagtccagtcttatttacaattaggctttttgataatggcttttgggctgacgttaagtataaaatctgaaattagattttttaaagattataatcaaaaagcaaaaatgtcttcctagaaatagcaaaggaatgcttttgctggatttgctccactaactcatgtaggcaatataccaaactcaaacagccagcagttgttttgtaaaagacaaactgcatctgaaatcagtatgacaggaccacagtttccatctcatcacttccaccaacttacatttaagaaagcacaacttgaataataaaaaccaccatagagtaaacaaattcttcaatgagaatgctttgaagtcaagagaaaaataggctcagggcattgtgttacagcaaaattttgcctttggcaaaagttttacgatggaatagggtttttaaaatattgggaatcaggtaaattgcatggctaattgaactggggaagacagcttaatgagctcatttctctccttcaaatccaagaagtcagaaggcaagttttcatctattctttcatttatccaattagaacatatcgtccccacacatagggctactagaagaagtaatagttatgtctgatggctcttaggaagtattgtcaatagataggacctcctctgtagttataactacagatgatcaaattaaccagaaataaattttggtcataaatttcttcttgctccactctgtaggctacctcctccaaagcagatcgtagaccagtgcatttataaatcacagaatcaccttttaatggttatagactatatatagcatagtgacagtcatatactgctggtgctggtcaaacttgagatcaacaattctgttggatttttacccctctcttccttctttttcctcctcttccatattctgactttcaggtttgagcatgtaataacttccaggatttgttttgggcattatttatatattaccacttatcctaagattattttgagtcagataaaagtaagacattctattaagttatcttcattttgaagatgaagaaactaagattcatagaagtaaagaggactctaggagtaactaactgtccattgtcattgttaatgttacttaacctctttaatcctctgtcgtgaatccaataacgatcaaagtagtaggcaagtttgctgagggccaactgtgtgacaagcactttgataactgattggtctttacagcaaccttatgagagaagtattattactctcatattatgagtgagaaaaataaggattaaagaggtacaggcaattactcaagaacacagggctagcaaatcaagaaacagaagttagatgtgagatattgtatcacccaggcctaaaagatgcaatgaaacaacccattttaaatgtttaatatagtaaccagagtatactctcatttgatgagagtatactcatcaaatgagagtatgcatttgatgttacttttcacagtggcctttttgcagttaggaaacagcagcaccaataatagaactaagctgtctgactcccagcctgtacctaaatctctaacttttgattttatgaaataaatttgatttgcagatgggcattgctggtgagggaaatgtaaagaggtcaatttccccactttaaatttttttggctaaagacccatagctgacaatattttaatggttgccacatattcttcttttatgaagtgagtttcattttatatttgtaagtggtttttattgcaaatcatcacctaacagtcaattctgaagactttccataaatgtcaccttgtttgtgaattgttctcattctgtctcctctctaaattccctcaagaacaactttctttggacattaatatcattattaattgtgaattgtcagctaacagcttagcaattgtctatcatgctcctaatgcatggatgatacagagaatataaagtcaataacttgtatttcctgaaagatacatatacagaagccaatcatttcagtagagtgacaggagcaagattgaggtattaatagagtactctgagagatgagaagcgggacaactaccttagcctaaaggtttgcaaatgattgtggggaaaaataatctttatcactccaaaaagaatattacagtgatattttaattgaccatagagtttaacttgaccattgtaaaatgaccaaaagggtgaattattttttaccaattattaaaaagtagcactacctgatataaacagtgtgacctaatgtttacattcttattattttttctcctttttgtctttttctctctccccagctaagtagaaaaaactcactttgttttcatgctaaaattttggaataccattaaacagcaacacactggacaactacattcttatgttttatcttctccctttaagattgttaaaggaagaaattgaactagtggggaaaagtaaatactggccaaaaaaaaatgcttttgactagtgtatgttccaatgatgattatgaaatatgtcaaactgttctaaaatactaaatatgtgttactatttattctgtattaaaatagaacaatagaataacctttgttgtcccaatatgaaaatagtttttaacaatgttaatataaaacaaagagcaaaggaccattatcttggataaacagagagacattactttacatggtttgactcccctgattcataatttaacatgtaactctggcatatgctgggcacttagggaagtcacattaagtatttcacagcaaatggagagtgagaaaaatgattttcagaaatcctggtatttacttattataaatcttgtcttgaatttattgtactttacatgaaatataatttgataaaatgtaattggtttcagtgtgtatgcaaaatgagaattttctgatcattcagatatcaaaattaactttataaatacaaatacatataattacctattaaaattctaaggtgtatttattttaataaaagtctttatcaaacctagataaatctcatttatgattataaatgtaaaactcctaaatttttttttacttggctttatttactattaatgatgttgggtttattaaaaaatgcaagcacagactccaattagcctactaacctattgtataatttatcaattcaataggtcaaacaattaaatcagaacatttaataaaattgacaatatttttttatttttttacaaaaatccatattggttgttttgaagtagcaatttcttcttcaaaatgataaaaattgtctatgtaaaatcaatagtcaatactataaaagctgcaacattatagacattttcattaaaatgagtaaaaagataattatgcctatcacactactataccatataaattaactattatgctgaaaattctggccaataaagtaggggaaggaaataaatataactgtatatttaaaattatgaactaaatcttcactgttttacaggcaaaggaaaattctaatatctgataaaatctttaaagtcaattaaaaaagagtatactaaagaaaaatgaataattttctcaaaaaggactatatctaaccaagaactaggtgaagattggcattactagtatccaaagacataaatactaaaacagtaattgacatattatctaaaatcaaaatagtgaagatataacaattatgggcagaacacaagaaaatggacattctcagatattgctggtgtgagtatgagtttaatttttctagaaggaatttgaccatatttaacaaaatctttaaaatgtttatactctttgataatgtaatttcatctcataattttcttaaggtaatacttagatatatatccactcccgatccccaaaataaaatggaaaaaaaaaaactaaatgtgtaatgattgcagaagggttgaatgttattttatgagaaatataagaaataatgcagcaaaatacatgatgtttaattatacaaaactatgtagtaatacaaaatatatgatttttaataacacaatacccatgtatattcataattttgaaaagaagaaatatatgcatatacaaatttgaaagaaattatctcatgttgacattttgacttatcatttgctagtcaaattaccagtgcttttaattttctacctcctgcctttgttttataaagaatatttttattatgtctatagttatactaaactcagttcagttgaattgttatttaaatctatggaaaaaattttgctttgtccataaattgtatttatattagaaagttaaaataattaattataaaacatatatccaggtttttttatttgttccagtacataacagacctattacataatttgagtaaattttgtcttacagttatacaggcagttctctccttacacaattctgatatgcatgaatatcagttatcatagtttagttaaatgctaacagtcctccaacaacgtaactcaagtgttgggtaacattgaatattactgtgagtaattacataaacaaacattgctgctggctctgcagtccacaaattaccacataaaataacagatgcacattgtgatcagtgaccgatcacgtttatttttttcagtatctgttggtgattgcgcactacacatttatcattcagtttatttatagaagagaagcgtgtggttgtgttgcctccttgtgagtgataaacccgagtgacactttacaaacacagatattcaaaaaagaagaggaattggacagcaaagaggaaagcactgcaaagaaagaaaatacttgaagtaaaattcagattgaacctaagtggagtcatagaagaaatagtcactactgaggtttgagagattctgaatacgtagccagagctacttagtgaaggtgaacttaacataagtgagggaagtgcttgccacaaatagggtgaagatgtcctggaggaagtgacacccaaacacttcacattagaggaattctcacaggtacttcacaacactaaaagcataaaagttaaaatgttggaagctgattcaaacttagaaaggagcgtgacaattcaccaaggcatagaaaagaagtggccgggtgcggtggctcacgcctgtaatcccagcactttgggcggccgaggtgggcagaacacgaggtcaggagatcgagaccatgctggctaacagggtgaaaccccgtctctactaaaaatacaaaaaattagccaagcgtggtggcgggcgcctgtagtctcagctacttgggaggctgaggcgggagaatcgcttgaacccgtgaggcggagcttgcagtgggcagagatcatgccactgcactccagcctggggaacagagtgagactccatctcaaaaaaaaaaaaaaaaaaaaagatgcttgtgttcagtgtgataagttataggtgagatgaaggcaagcactgttcaaagtacttttagtgagtattttacaaaggactaaaacaacttctccaagtttttaatgttttaaattacagagtactaaataaatggtcatttttactggtttatttctttacatttataaccagcattggagagttgttaacatgttgaagttttacaaagtcttagagctatcataacctttcctgttgattattaagatcactttgcatgtttgtaacacaaaggttaaacacttgaggggatagatgtcgcattttccaagatgtgatgattacacgttgtatctctttttcaaaacatcccatgtagcctataaatacatacacctactacgtacccacaaaaattaaaaattaagaaaaaaaaagatcattttccatggttcaagtttgcatggtcacttttacaattccaccctaccatgcccgtaaatatgctatttctgacttacgaaatatttttcaaataaaatcattgctgacttttaactcactgatatgtgctttacttctggtgaaaggcctaacatatcaataaaatgaaagaaaatcacagctttattttctttactgttctgatattttttgttctagtgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggtaagtagcaaataaattcctgagttggtttggaggcctgtgtgcttctatctacaatgcatattattttaaattatgttattgctatcttatttaaggatgtactttcatacctttaagtttgaaaatcaaagctagttcaccaaatcttcctatttccaaatcactaggtagttttcagaaatagcactctagtcttaaactatatcttttcaggaaaaggattttgttgttgttgttttgttttgttttgttttttaaagagttcacaccatttgactaaaccacaaccatatttagaataactcgggaatgcttactttgaacacatatccttaaagtaagtttccttttgtcccctttattgtcctttatgtctggattctcatgtggagatggcattcattcagatttggcatggacactggtagtctgagaatactctttttgaaaatactaattaaatggagacgatgataatcaaagtcctgttctaaaactacaaagcctttgactagtcattgaaaaataccatccttattttgaaaggcaagaaatggccaacatctgaatttgtgaaatataatagcatatatctgatgggtttcaaagtggtactcttaagcatgaatccatttatcggctgattattgataacttaaatatcacaagatcttgggtaggtgctggggacatgaagatgaataagacaatgaattttctgtctttgggttattgtacagtgggaaagacagactattgaaaggaatgattacaaagttgtctgatgattgctaagatagggcaaggacagtaggagttaaccagttgaaagattaggatggtgaactaaggcttacaattagggaaacattttgtgcagtggcctagaggagggagaaaaatgacacgtttgaaaaaccataagatgggcaaatggctggtggtaagagatattaggaaggaaggcaggacaatatcatagaggactctggagccatgataaagcctttggcttttatctaaggtcaaggagatgacacttaagggttttatatgggaaaggggcataatgagttacttgttattaaaagatacacctggttataaagtaaaaaatggattggagaaggttagagtggttggggaaaactagttagtgaggtgctgcaatagtccaggtgagaaataatgtcagaatacatttcagatggtacggatagagagaaatggatccaagagatatttaggataaaaaagtgagtgttttgtgagcagagtgtaggcaagggaaggaaggagagccaagactgatacctaacattacattctagcttgagcagtaggctcaacattggtgccagccattgagatagaaaatacaggaggattgagatgagggaggagatggcaagttctgttgtggatatgttcactcggtttctaagagacataggagaaactcctgggggcagttggaaacacagttctgaagctctttccttcaaggaaatcctctcatgatgctttagagaagatcagaatcacttacacatgttagtgacaactatgcttatcatggtttataaatgtgtattactcctggtattatttagttcagattcctcttacctcctagactgtaagagagctttgtgaaagagatgcaatgggtattgtgtatttagtttactactgtattacacagcacttagcacagtatttggtacatagtaatcacgcgataaatattcattaattcataaataaaagagagatttctggattggagatatggatttgggagtcaacagcatatgtaaatggaaatagtctagaaatattataaatcaatttaatttttaactagctcaatagccaatatctatcagaatatgagttttcatattattgattattgattatttctgtagtcttcaaatattggagaaatttcaatattttttgagcaaagtacatcatgtttaaagggggaattgatagtcttgagttctacttcagcttatttcaattatcttatacactagtcacgttcactttaaaaattccttgtagtttaggttttttattacataatatagcaaaggaaatttgtaattataaattataaactatgggaattacctgatatatctaatatgtcaggctattctagtatttagtatgaaaagtacttggtatctctaaatataatgaatttctatttcaatctttgaaatgaaaaataatggccactaacataatcatttgtttttaattgtgttaactacagaataataaattatattaagagaagtctcccattttacatgattgagttctagaaaaatatttccaatactacatacctgcttgcttcttactgtataagtatcatctaccacatatgtagaaatttctcctgctgtattgagtttagataaagtgcctggccccagatataaagttttaagtttaggagcaaactctttccaaatgtatgggcccctataaagcacagctttttagaagtgtggtattatataacagatgggagtttaatgaagtaaagcacagtttgtaacaggttcattgtttcatatgctctggatcactaaattggcaggtagagatgaaaggtgcattaaaacggacgttccgaaaattatagaattccctcaaaggaatacagtctttaattttgaattatgcagctgattttaatgaattagaagtcataatgcataacctttccctgatgcaggaaggaactgtgagctgtgcaaggattactttttccgacaagttggtgcagatccttcggccatagatgtttgcaaaccctgtgactgtgatacagttggcactagaaatggtagcattctttgtgatcaggtgagtttttctgagtatttaaggtaaaggattactctgtctgccagaaacttatttggatgttattccactagtagaattgaagactgcatttgccaggaaatcctctatgtgcatttgcatttcaaagagatggttgttcgtgtgcaactttgagtatggacatgaaatatagcactagttcggtggtcctttgcatataaaaaggcttattttagttttaattttacaaatgtcaaaaaatcgaagggtaggggttctaagtaaattggggtatatgtcttggaattattggtgaattaatattaatacatgatataaataaacaagaatagtttctccaaaaattccatagaagatcatatagcaaaagtcacttacacttagggccaaatggaaattatgatagcctcgcttctcaatttcttagtctaactttccctcttaaaagtacaatggattttttataattttaaaactttctgtttacttacatcacaaatatcgatgtctagcctacatgcacacagattctaactaacctcagttcatgtatcctacctcaagcaggaaaacaggcttcttattgaagctgaagtttttcctgttctgataatactaataagtgaaaattgtgaaaatcggtaaaggagaaatttactttgaagaatcaattcaatgattgtattaattttaaacagttatatactctgttatgaataaataaggctaggagcataaaccacaatccagttatagaatatttgttaaaaagttatattgtgaacataatacacacaagacaaaatatctttctcctataattttgagaattcattaaaaattgctttcccaaataaaagacaaatataaaccaagacaaaatatggattcaaagaccttcagagtaaccatcatgtgtcaataagggggcattacatgcttcattagaaagctgaagagtagaaaaattattaataaagacaatttctactatttttattttataatattgagggactattttctcagaaagtcatactacagttttccatatattaattagtaaactctgactgtatctttagattatatttcatttttacacatccaccctgagttttcagcatggctatcttttgcttatcattcaaatattgatatatcatattttgagatatctttgctgaccacccaattacaaaacattctcaagtctttcatatcaccatgttactctcattacaggctctgtaaaattaatttatttgtttacttttcttcttctctctttccaacataaacagaacagtttcgatcatataaaaagcccccaataagtatttgtcacataaatgttgaatgaataaagagagattatctgagcactgatcttatagttagattgttattttaaacggtcattacaataatctgagcattatgtaaattttcacttgcagaacagtttttctccctgaaaatctaaggtcaagagctttgttatatagtataggaagactgtaaactatagttttacctcccagaatctcagttacgtgtctaacctacacgagttacagtgcatcagatttgtctctccatttcaccattcagatctacaagaaattgaaacctgatttttctgaactcaaacttctatttcaagtccgttttatagggatgctagacaaccttgggtggttctgtgcttgtaaataattaacaactgactaagaaaaaaaaaaggccaccataatcaatttcaatctaccagtgagatgtcactgaacatggatttcagaagaaatgtacttaatctgctcttatgagccagtgcagtgtactccagcatactactggctctagatttctttcttaacatcttataaagtggagctaattattggatggaattatgaaagactgtaccatttataagcaggatattagctgtagatagtgttattttttaagttggagaaatttttctctattcctagtttttctgagagtggtttttatgaatggtgttgaattttgtcagctgctatttctgcatcaattattatgatcatgtgatctttttttctttagtttgttagtgaagtagaatacattggttgcctttcaaatgttgaaccagcattgcatccctggaataaaaccacctttgtgtgtgtctttgtgtgtaattcttttcatatattgttaaattttatttgctaaaattttgctaaggattttacatctgtattcataagaaatattgctctatggttttgtttttataaattgtgtttgtttcattttgttattaggataatactctcgtaaaatgaattataaaatcttccttcctgttgtttttctataagaaatgcagaactggtgttaattactctttaaagtttaccccattctaatacatagtattctagtaaatacagtaccccatgtattagtccatttttgtactgctgggaagaaatacccaagacagagtaagttgtaaagaaaaataggtttttatttatttatttatttatttatttagagacagagtctcgctctgtcacccaggctggagtgcagtggctcaatcttggctcactgccacctccacctctggggttcaagctattctcctgcctcggcctcctgaacagctaggattgcagatgctcaccaccatgcctggctaatttttttcttttttttgtatttttagtagagacagagtttcaccatgttggctagactggtgtcaaatcccacccacctcagcctcccaaagtgctaggattacaggcatgagccaccacacctggccagaagaatagatttaatggacttacaattctacgtggctgggaaggcctcacaatcatggctgaaagcaaaggagaagcaaaggcatgtcttacatggcagcaggcaagagagaagtgccgagtgaggaacagggaaagccccttttgaaaccatcagatttcatgagaactaattcactatcattagaacagaatgggggaaactgcccccatgattcaattatctccacctggttcctcccacaacacatggggattatgggaactacaattcaagatgagatttgggttgggacacagccaaactcacacttggcccctcccaaatctcatgttctcaccattcaaaacaaaatcatgcccttccaagagtcccccacagtgttaactcattccagcattaactcaaaagttcaagtccaaagtctcatctgaggcaaggcatgtcccttctgcctacaagcctgtaaaagcaaaagcaagttagttacttcctagatacaatagcggtacaggcaatgggtaactacacacattccaaataggagaaattggccaaagcaaagggcctacagtccccatgcaagtctgaaacccaatggggcagtcattaaacctcaaagttaccaaatgatctcctttgactccatatcttacatccagggcatgctgatgcaagaggtagctcccacagccttgggcagctcggcccctgtggctttgctgggtacagccctccttctggctcctttcacaggctggcattgagtgtctgtggcttttccaggcacacgatgcaaggtgttggtggatctaccattctgaggtctggaggatggtggcccccttctcacagattcaccaggcagtaccccagtggggactctgtgtggggggtctgaccccacatttcccttccacactaccttagcagaggtacttcattcattagggctctgcccctgcagcacatcctctgcctggacatccaggcatttccatacatcctctgaaagctaggcggaagttcccaaacctcaattcttgtcttctgcacacctgcaggcccaacaccatgtggaagctgccaaggcttggagctgccattctctgatgcaatagtctgagctgtatgttgatcccttttagccatagctggagcagttgggacacggcaccaagtccctagactgcacacagtgggggggccctgggcccatgggaccattttttcctcctaggcctccaggcctgtgatgggaggggtgatgagacatgtcctggagacactttcccccattgtcttggtgattaacatttggcttcttgttagttatgcaaatttctgcagccaacttgaatttctctccggaaaatgtgttttgcttttctactgcattgtcagcctgcaaatttttcaaacttttatgctctgcttcctctttaacacttactacttagacatttcttccactagataccctaaatcatctctttcaagttcaaagctctgcagatctccaggggaggggcaaaatgccaccagcctctttgcatagcaagaatgacctttactccagttccccacaagttacttatctccagctgagaccacctcagcctggcctttattgtccatatcactatcagcattttggtcaaagccattcaacaagtctccaggaagttccaaactttcccacatctttctgtcttctgagccctccaatctctttcaaactttcccacattttcctaccttcttctgagccctcccaactgttccagcctctgcctgttacccagtcccaaagttgcttccacttttttgggtgtctttacagcagcgccccactacccagtactgatttattgtattagtccattctcactcaactataagaacaaacctgagactgggtaatttataaaggaaggatgttaattgacttatagttcctcagggcgggggaggcctcagtaaacttacaatcatggcagaaggggaaacaaacacatccttcttcacatggtgacagcaaggagaagtgccaagtgagggtgggggaaagttccttataaaaccatcagatcatgtgagaactcactatcagaagaataggatgggagaaactgcccctcatgattcaattatctccacctggttcctcccatgacatggggattatgggaactacaattcaagatgagatttgggtggggacacagcgaacacatattgctccagtaaaactatctcagatttctttggaaacagaaataatttattattaattcaaaattaaatactacatatatatgtacatatatgtgtgtatatatgtatatatatagagagagaaagacagagagagagatacaaggaaatgagagtcatattaacatcattaggaatttaatattactagaagacagttcagaataaccttaaaatcccaaaagaagacattttgaagaaaaacttgatactcagttctatccaagctatggcaccaacatgaggttaagattctttttgtacgagagatggtcaaaacattaccattcataaccccatattaaaatattcaatatgcaaagtgaaaaaggaatgtaagactggggacaacattaaacaaaggaaatgacaaacaattatgatccaaagaaataaatacataagtcaaaaaatattttcaaagtatccattggtctttatggtctgcaaggatagtttccttacatacatgtttagtaattcaattttatttaagatcaaatcacaattttttgtgatttgagataaacaaataacaagtagagggctaaaaatactatatccaaatatttcagtgagaaactggatgcttttttcctaagatcaaaagcaagataacaatatcccataacattgtactgaaagttgtagccaagaaaatgaaataaaagacattgagactggaaaaagagaagttatttgtatttgcatatgccattatcttatagatagaaaatcctaaggaattaattcaaaagtattaaaactaataaattcaggctgggcgcggtggctcatgcctgtaatcccagcactttgggaagccgaggcgggtggatcacgaggtcagcagatggagaccatcctggctaacatggtgaaaccccatctctattacaaatacaaaaacaaaattagctgggcatggtggtgggtgcctgtagtcccagctactggggaggctgaggtgggagaatggtgtgaacctgggaggtggagcttgcagtgagctgagatcatgccactgcactccagcctgggcgacagaacgagactacatctaacaacaacaacagaaaaaaacctaataaattcagcaaggttgcagagtacaatatcaatacacaaagatcaattatatttccatatatttgcactgaacaatctgaaaataaaattaagaaaacgtcttttaaaaatcaccaaaagattaaaatatttagaaaaacatttagtaaaagaagtgtaaaattatattctgaaaaccataaaacattgctgaaataaagaagaactaaataaatagaatgacacccaatgctcatgtatcagaagacttaatattattaaattaacaacactctccaattgatctacagatttagtgtaatctttgttaaatgcccaccttacttctttgcagacattgaccatatgatcctaaagtttgtatgaaattcatgggactcaaaaatgtccaagataaccttataaaaaaagagttggaaaactcacccttcccaatttcaaaatttactataatcaagacagcatggtactgggataaagatagacatagagacatattcactgaaatagaattgagaatttacaaataagccctcatatttatagtcaattgatttttgacaacagtgccaagacagttcagtggagaaagtgtagtcgttttaacaaatggtcctgggacaattgtgtttttatatgcaaaagaatgaacttggactcctaccccacctcacatataaacaaattaattcaaattaaacaaaatattgaatataaaagctaaaattataaaatcttgagaagaaaatgtagatgcaaatcttcatgtcctcggattagccagtggctttttagatatgacaccaaacgcctaagaaacagaagataaaatgtgtaagttggacttcattagaattaatatttcaaagcacaccaacaagaaagtgaaataaacaacccaaagaattagttgcaaagtatataataaatctgtaataatgaagaaaatatttgcacagcatatatctgataagaagcttgtctagtatatatgaagaacttgaagtgaataatcaaaagacaaataactcaattttaaaatgcgcaaataatctgaatagatatttctctaaggaagatataaaattaccagcaagcacataaaaagatttttgacattagtcatcagggaaatgcaaatcaaaactactgtgcaagcccacttcccaaccagtgggatgactgcaactcaaaaaaaaaaaaaaaaaaaaaacagacaaaaacaaaatttggtgaggatgtggagaaattggagtcttctcataggctgcctgtgagaatgtaaaatgtgcaccgactttggaaaatggcttagtgtttctcaaaatattaaagatggaattaccatataacccagaagtttcactcctctgtatgtatcatatatcctcataaaatcttattggtgaatgtcaatgccacattgtttgtaatagtcagaatgtccatcaactgctgaatgaatagataaaatgtagtataatcacacaatggaatattattttacattaaaaagaaagaaattactggtacctgctacaaaatgtgctcaagtctcagaaattagagtagggaaaggaagacggacgaagaatagagaaagcttgttttgttttgtttccaagtgcaaaaatctgttttaaaaatatatggaaggaaagacatgctttaaaatgttaacttttttggttttaaaaacatttttccttttatataaacttttttctctttccaaatctgctttatttataacttttatagtcagaaaaaaaggagaattttcattcaacctgatatatagccagagagaattacacataagaataggaatgtaaataagaatgatagaactgttttctgactttaaacccccacattgtttatctttaaatcacattcatatattatcttaatttttattattttctcatgctccaagtatagagacaaagtttatggagtatcgttacatgtggagatattgtgtcaagtctaccttacctaaataatgttataaaagatttcaaaaaatgtttccagacattgtcaataggataacagaacacacacttaaaaagttgtcaacagtgtcagaattataaactgcaaaattgaattcaaggacatttaaaaaattcatgcaatttcaatccttaataatattagggagcacacaaggaaattaggcagtagttcaagtctcattttgttataataacttaggaatgaagccagccccaaatggcctgagtgactgtgtcgtgcgctctatgttctggaagggaactttccctttggcacttgtcatttgaaactcaatccaatctcataagatatggcatgtttgccttattcttccataagaaatgttgtaattcttccttatgtgaatgccaaaatcttgagaggggcataaagtaatgctctgagtcactgaatcctaaaaatactgatgccacagtcaagacagagagaacatctaaagcacagtactaatattaataggagagaggaaaatgaagagtaataatgattattgaggaataactaacatggaatccttggatcccttgggttactatatgagtgtatattttatgtctgtataaattgagtaggatacaatttatgtctgtgtcatacaactgtaagtctgtgtatttttccttttttttttcttttgtctgtatttttgagggtgagagctttcagtactttcatcagatccaaaagggatacatgaaccaaaaaagatgataattatttcaccatggaaaagaagtctatcttatgaacaggctgggttattagttcaggtacatattatgtgagtttttcaggataccactgcacttccttcttgtttgcttgaacttaatgcatgaattacttgacatgcatcctgagttggaggttaactgtccttttccatttcctcatctagtgtgacttaagttcagatcaatcaaatagagtcccaggcctagatgatgcctcttctgtactttgacatatctggagaagggtctgtgaatccacacctaaagtgcatacatctagagatctcagtctgatcctgacccaaggtgggagtgagccgcttgtctccatcctttccctccactgaccccactcctccacatattttctggtagccccagagtccctgctatagccacctccacaggtgatggtgataaggtagggagaccggtgaaagtccctaacataagtccctagcatatggcctgactcatgtagaatgcattcaagaaatattgtctgagtgctttcttgcttgggacttttttcatccctgctaccttctctcccgtttactttgcttgttattgggttgagctgaggaagccatgggggttcagccactgtagtcaagatggtggtcatcagctagggtagtcctcaaacttttaatgcacatgtgactatcctaggtatctttttaaaagacagattctcattcaggaagtttggggttggggctcagattttacatgtgtaaaagttcccagatgatacaattgccgcctgtctgtgaaccactttttgataaccaaggagttagaacactgtatatcaaagatatgtagaccaaagaagctgaatgtagatgggggtaggggagttgtgagtgtgtactcacgagcacatgtatactcttggtcagttgtgggtttactttgctccatcctctgaatcccatcttaaaagcaaggattttccaagtcatccaaattaagttaggcttgaattgtgccctgggctctacctttaaaattagagtatatcacctaatagccatttttaaaaggaaataaaaacaacaaataagggaattaaaaagttgtgtgaaaaccaaaaatatagttgtaattatataaaaagagagaatagcagattgtaatgctcaataaagcatcaataggttactgtaatagcaacagaacagaaataaatgattaagagatatttaaaaatagattaataagaaaggaaactgaggttgaaatgaattagacgaaatggaaaggcatcagtgaaagaagcatttctaggtctgacctatggaagatggaataataaggaacagagaccctactcatgaaaattgattgttctggtgaagtgataattttcaaaacaatacatttaaaatttgaacagaatatactttctctgcataatgtaccatttttctgcagttcattaatggtttctcttctgttcagaattaggtatttgtcattaattaccataacatgtccaaaagtcatcaggtgaacttccctgaagtatattcttatattttgtatgactcaaatattaaagtgtacaaatagaaaaaataagtattgcataagtttccttagcttatgagaaacctgaccatgaatagtatgatccatggatattggatgtatacattgaggtggtgaaggatgtgaaaagaggagagttttcccagagcttcaatagagacagaaaggtcttggcacaagccacgtggtctctccttcagagaattagggaagtttagtagtaatatttctcatagagctggtaaattgagtaatatctcattattctgagattgtagaggatgagattcacaaagacaggaacaaaggtcctggggtataaatgggaaaagaagggaaaaattaatcttagctggataggaaggttagtattgagggagttatccaagaatcaaggttgtgacaaactgcctgaaagtaaaaatagatggagttgtaactgagatgaggtcttagcctccagtttatgttgagttccacatgtttgaatacatctgacatctttttgggaacaagctcatcacaagggcccaggtatacaaaattggccaaataccaatacctcaggcatttaaggctagattcaatagccctaaatagccataatagcactagcagaagcattaggtagtgtctggatattggaagaactgatttaactagtaagtgcaagataatgtgatacaaggcccattgccttgctaccaatagcaatgtagttagaataggctaaacagatgtaacaaacccccaaatatctagtggccaaaacaatatacaggctcatttgttgctcatataacctctccaagacagctgttcctacctccttgttggatcttctctttgtgacaattcagggacacatgctccttccattgcctggatatgcctttaactagggaaggaaaagacaatgtggaaaacaacttccacttttaaaatgctttggtccaaaagaggtgtgtgtcgcttctgctatcattgccattgatgatagctagtcacattgctaactagttatatagaaggctgaagacatgtagtctctagctgggtaaccactttgcagctacatttgtgtactattgaagactagggagaatgagtcttgatggggagcatgtcatctctgcttaatactcatgcaacagaaggtagcccaagagcgaaaggggcattctcttcttttctacacacagaacaggataacttctgtttaatgaggacctctgagaatagagtaccccatgagcatctcaggggtgccaagccattaatattggtgggactacctgcttggaggtggaccctgtaatattggtagatgcacctgtgaaagcacatatcatagcagcatgtatcagcaagagagaattggacataggaggagaaacagcttgtgtgcaaggttaaaagatttgttcatgagcacatgtgagagagaagccccaggaacaaggaaatgagaaaacaattactgcctcctacatgttcccagaggagggggctgggagagcaattaagcataaagagcattaattgcatagaagatgctgagggatcatagatttgaaagcaatttcaaaatatgagtattttaagacttttagcaagaacagacaccataggctgtatatagtttcctggagttatgattaaaggatgaaaacaacttttgtttagatatgtaggtaggtaagtaggtagatatagatagatatgagaatagtaagtttgtttaaacaaattattcattacatcatagtgacccttagtgctttttgatgatactgactgatatggtttggctgtgtccctacccaaatctcatctaatagctcccataattcccacgtgttgtgggagcaacctggtgggagatgattgaatcatgggggcaggtctttcctgtgctgttcttgtgataatgaatgagtctcatgagatctgatggttttaaaaatgggagtttacctgcacaagctttctctgcctgctgccatccatgtaagaggtgacttgctcctccttgccttctgccatgattgtgaggcctccccagccatatggaactgtaagtccaacaaacccccttcttttgtaaattgcccagtctcaggtatgtctttatcaccagcgtgaaaacagacgagtacactggcttattgaggaacagaatataatcagcctccttcattcctcactcactaaaccaatgtgctgatcatttctagaggcaaggacactccaagaatcaagaaagagccgatgatgaggctttctattattctcctggactggacgttgtctcagcttctgctgggccatagaaccctgcctctaccttgacttacccacatgttgttttggtgccaagtattgagtgctgcattttggggtgtacaagacagattggcatattgctaaaaatgtgcgaggacagaaatgacagaaactagtctgtaagattctcataggttccacttgtcttgcactcgtcatgtacaaaaatatgccaagcattgtagttcattaattcagtccttaccaaagctggtaaagcagttattaatttatccactgtaaagttgaggacatccagccttttggaaattaaataactcctccaatatcacacaagtaataaggaggttgtgcagaaattgaaaacttgtgaatttccaaagctcatgcccagctggaggttagagacatagggttcctaccaaaaatgtgttcctagcactcagcatagtgttcagcacttaagaggaaacctacagcagattgctaaactgggtatttacttacactatccaaaagtaggaaggaaacatacccatttgtttgtgaattattgtatcaaatcctattaatttcatcctaaatattaaataaaattcctaaataggaaatagcaatgttcatataaagaagcagcaaattaatttattggaatcgacacattcctcaaatggagatttggttgatattagagacttaatgtacctcccttagtgcttaatgtataacagagattccacttatcttacctatataacctaagaaatttgaatattttataaagttactttttagaaaacctgatttatttgttttccttgtcatctcagatggataccttcctctcaaaatctatttggaatttatattttcaagtattcaattaactaacatattaagcaggcattctcctgtgtaagttcctagcaacttttaccacttgtactaaaataaaacagatagttaagccaaatgagttaacttttctgaaagtgtatctttatacaacattaactatagacatggaaaatacatttattcacgttagaaataaatgcttctgtgagatctttcattttgataaagtcaaaacaccatcttattaataactactatattaattttgcagcaaattacaataagaccacactgtatagttgtgccattcagatgacatttatgaaatgctctaatttaacatggtgacatatattacctgcatcttttacacattatagcttatatcctctgagcgaaatagacctaaaccatccaaaaaaaaagagagagagagagagaataatgcaatgggaaattatacccctttgagaactagaaggactataattacattgcttcctcttaaaaccattcaaatatgtaaccattgctgggaacagcagtatgtggggaacctctttacactctttctgtcttgaacactcaaaagattgagaaaaaaatattcctttcctactatagttttatttgagcatgcttcagaattttacctttttgcacactccttagagattatcgtggggaagtttagaaagcagtttcttggaaatgccttttggaggggaagaggagctataaaaatataccagcctgacaaatgacaggcattgtagactggaaaagaaaagacatcttggttttacaccaatgtagaagcttttctttgcaaatgagtatttttgacagctgagcaagatgataaacagaagtatcacaaaacacttaaatggaaacaagtattatgatgtactttattcacctggcattctccaattcatgacatttatatgtggcagaacccactgcagattcatttatttatttttgaagtggaatgagttccttacgaaggtagcctgttacattaatgtggacttttcttctctagatgcagaagcttaaggaaaaaagttattgtatctgtactataaataagtggtaagtctcagaatccacatcttagggctgagaaggctcctagcaagtacaatatactgtataaatatagacaaataaatatagatatagattttttgtgtaagcaccggcagtgttgcaaatgattagatatttcataaatgccttttctaaaaaggtattgctgaaaccagtctatttctagaacttatattcagatgtttagaggtataaatgcttcaatattggctaagcttagaaaggctatgtttctctgaggctcagtgatagacataccaacaatttgatgagatgcatgactaagaagaaaaagagagtaagactgagtccctgtgaattgattgacttggtgcagtggcagagtaggtagcaagtattaaagcaatagttcttaaatgttagtgttcataagaatcatcaacagaactttttaaaaatgaagattcctaggttttaactttagcgacttttaattctttaggtctggtatatttggttgtgggaaatcaaaagactcaacttcggaatacactgaacagttgctgactatagatttgtatattcaaaattttttggtatttaaaaatggtatgtatggtttattgagtcaaatattttaaaaactatgaatgtgtgctggtttgtttttttttttttttctggattggaggacaatttggggtaagcattctctatttaacaagtcataattaactccctgccaaaactaagtagaaattgtgatttctataactcctatatttgataatatctcctaaaaatatttcagtgatatagcatttaattgcaaataattcatctagtcaccaaacaaatgtagggacgttcctatataccaggcactgtgcatatcaaggtgtatattacagtgaataacagaaacactcacgaagtgttcaattgaatttaaccttgaaatgtattatttattattattatgtttaaataaactatgtgaggtttttttttcattgccaatgagaaacccaccctaacttcagaatttttatctttaagtatatcctattttaaccacccttacccatccactctcaatgatttctcctcagtgtggggccttgccgtggaagtgtgccctggtcagtgagttttgagagtccgtggaagctagattgccctcggctcttcagttcccactgcagaactcttgcagtcactggctattggatcagcagaacctcttctattttcagtcgcccattttcaaattggctcactgaactttaggttctccagttttcaggtctttcaaaagtccgacacccctttactatcatctgctttctcctacacaggggctaatgccatgcaggttttgtgactgctggtggtgtgttcctacctgctttttttgggaggcttctgggcacagctggtcacctagtttcattataatcatttttaatggctttgctgttgttgtgttgctgtttagttctgtcagcttttatcctgggatttagagagacccaagagttctgtggccacataaccattgatcctgattcccctggagtctcttttgacttttactgcctaatttaagctgaacatatgaaatacatgaaaaaactgaaagctcaagctcgtttgttgtttgtcttcctaggttatggtttccatttctccctctttctcaacctattttgccaatcaatgtctatccttccttcactttttgcctactcactacaatattcaattacacaaacataatttttcctctgcccaccccagcaccagcatttttctgggagtttaagtctcttatgaatctgggaagaaaggaactaaaaatgagcagggatgaatagcaaaatgagtgagtcaacgagtagcaggcaggacattagagtgaagctgttttcttacccagaagactgatgatgggaaaggaaaaaagaacaattcaaaattagtagaagaaaagaaataattaataaaacatgagtggatattaatcaaatagaaattggacaaaaaatagtgaaaatgaacaaacgcaatagtttgtcctttgaaaaggttaataaagttgatgagcagaaaacacaaagtaccaacatcaaaaacacaaattaccaacatcagaaatttaaaaaagagacatcaatgtcgttgcacattttataaacattaaaaaattacagttttatgaacagctctgctaataaatctgatgtcctgaatgaaatgaacaaatgaacacaaaaccaacaacaaaaaatagaaatagcctcacatatattaaagacatttaattcatatctaaaaacctttcaacaaggaaaatctcagtcccaaatggcttcactaatgaatttgccactaacataaaggaataaataatattagtcctacacaaactctttcagaaaaccaaggaagggcatatatttctcagctcattttgtgagggctacctaactttaatcccataacctaacaaagcactaaaagaaaagcccattagaatattccatatgaacatagatgtaaaataccttaacagcatattagcaaatggaatcctgcaatatataatagggtaatgcatcatagctgattggatttctcccaggaatgcaaagttagtttaacatctgaaaatcagttaatgtagtaagccacataaatagaatacaaaagaattcccaggtaatcatctcaatagatcaaaaaactttgaaaaagaattcaaaacactttcatgataaataccctctgcctactaggaatacaagagaacttcctcaaactgaaaagggcatctgcaaaaaccctatagctaatattatgttaacaataaatgttaaattttttaccactacatcaggaacaaagcaaggaggtttgctcttataacttctactaaaaattgtaacagaagtctaaagtaggacaaaatgaaaaaacaaaaagccatgaatatcaagaaagaagtaagactattattatttgcagaaaatatgccactgtatagacagtgggagtataaaaattgcttggcaagcatcaagtcccccacatacaatcccctcctcacactactctccttcgtaaagccatgaaaaaccgctttatattctaagtaaggacgggatgtttgatgtgcaaatgcagctgtaagataaatccctgagcaacatttttggccaccctgcccttcctatagaaagtctggggctgtcactgaggtagggttagtaatggtatgtgagactggagagatatgtggaaaccacctcatggtatttggtcttcactagttaggcaatagggagctattgaatatttctgagcacaggagtgacacagaggtgtaccaagtaggtaagaggcagtggaaacaatctacctcagtggggaagagtattgtatcacaaaatttgtttagaattgctagtacttggtgataattaaaagcaaaacaattttaactgaatcttattattttaattttacttacagaaagtgcatcctcttttgtgtacccaggtgtttcattctcaccaccttaccgtaggattattatcatcagaattaaagtagatgaggcaaggcacagtggctcatgcctgtaatcctagcactttgggaggctgaggcgagaggactgcttaaggccaagagtttgagtttatggtaagctatgttcgtgccactgcactccagcctaggcagcagagtgagaccctgtctcttaaaaaaaaaaaaaaattggaatgaatgaaaattaattgatagcagtttattaaatggattagggagaggaacagactggtagatatcattcagtatacaatagctggttagtgatggcaattctgaaagaagaagtggtagaaactgggaggtgttgctagtgtagtatgacctttcaaaactcacagagtgcatagcttgtggatgtatagaacaatgtgaaagaataaattctccagaaaggaagaagaggagttagagattttataaaagagaagtctatgatgttctctaggaaagaaaagaattttctgaagaatatatgcattgattaaatgatttccttttgccctcatttatatttattttctgttcaaatgaaacacttaaactaacactcaatttccgggacagatttcctgttcttacattcttcaatttgctttttaaatttttactttgtttagcaatatcaacattgcctcattggcttttagtgagtttcttgagaagatgtaatctatagaacattagttcttctctcccaccagacagatgagtgcatagaaagacatatagttatactgctgctgttttaaaagtgttgcttcaaattacctaaaatatagtgactattagataatcactgataaaaactgtgttcatctaatttattcatcttgaaatcatgcttcatatttcctttaagcacaaaatagttatgttcacacatgcacaataaatcatatatggattacttgatgccttgaattcaccctcatagaattttatctcctaatgtaaagaaaactgactggggtaattattgcaggatcttactcttttctgttgtcagtaaccttcccaccaaactcattgtgacaattgtcacccggttgactgtgcatatccaccattgctccagagcctaggccagcagacttttgctgcatggtccaaaatggtgaggtcctgggtgtgatcacaaggcaatatgcagcaaacattagtgaccatcagtgctaacaaagaaacttacaaagtaacaacttgaccacttggccaattcttccactgtgttttcagctcttcacaggtgtaggccatgccttaaacttaattgagtctagcactcttcctgttactattattatatttgtagcttatgataagcagagtgaatttaacataggggttatgatcatgcatttgagagttgggccacttagtaactgtattagtccgttttcacactgctgataaagacatacctgagactgggtaatttatacaggaaaaatttatacaggacttacagttccacatggctggggaggcctcacgatcatggcagaaggcaaagaggagtaagtcacatcttgtatgggtggcagcaagcaaagagagagcttgtgcaggggaactcttgtttttaaaaccatcagatctcgtgagatttattcactatcatgagaacagcacaagaaagacctgctcccatgattcaattatttcccactgggtctccccccacaacacataggaattcaagatgagatttgggtgaggacacagccaaaccctattggtaactgcaccacctttaataagtaatttgatctttctaaggtttaaattcttcttctgtcaaatgaagattcatgtattttcacaaataataaaatgacgaaaattcctgccactatggagcttacattgtaaagtgatttggggagttggaagagaaagaacaatcaataaatataaaaataagtaagtttatttactaagttaaatgctataggagaaaactagacaaagtaaaatgccttgagagtaccatattaaggaaaggaattgcagttttggaaatgtagccaagagacttttaattgaaaagatggcatttcacttgagacctgaaggagatgaaggagttagtcatgtggaaatctggaagaagagacctaggcagaggcagcagcctatgcaaacaccataaggtggaagcacccctgatgtattcagaaaaggggctgtatagctgaagtgagcagaagaaagagtaggaatgtcccaagcctacgggatccttgtgcaagctgcaaataattggtcctttcactttgcaagtactgccccacatccatcaaatactttagaaggtttgaaaaaagtttgactatcaatcacttgatgaattttcctgcccactatttgctctataccagtgtgaaatgtacagagtaatacttccacttcatctttaccgagcacttactatgttccagagatgatgctaaacatgtttacattaataatctcagttaatcctgacaacagacctatgaggtagatattattatgctcattttattgataaatacgtgaagacttcagtagatttaagttgttcagagtatagttaattctgtggctagtaattgtggcacataatcctaatgttccaggaatttatatcatttagttgaggagacactcctcaactcctgtctcaggtgacaggagtaagtgaaattctaaggcacaatatagcatggtgcataagcaggcaggactgcagccacagaaccctcaattttaattcaggctaagtcacttactttcccttttatgttagagacgtctgttagtttttctacaggaagtataatacctcacagggtaatttattcacaaatacgaaaacatgtataaaacatcatagcagtctgcctgcaatatcgtaagtgttcaaaagggttgtggatattattattgttgttgtaagctaaggaacgctagaaaaacatcaaagattcaattactcaaaataacttttgctgagcatctactacatgtaaaatatgtatactgtgggatcaatggatgatgtaaaggtgcaaaaggttctggcccttggggagtgtatggtacactgggaagttatattttcagacaagacataataattctaatacaagctagaccttaaggaattgaatgacagaggtaacaagaaaatgctgtaaaatggctgaggagagaaaaatcctctaatttgggaggagctcagtattgacaaaggctagaaatgggtagagaacactttcccaaaagagatgtcgtggtgcctggtgagacaggctgtgaacttgacttctcccatccgttccattattaatgtgtgtctctgtgctctagcattcatttcatcttgtggacatgctattgtttccatttaaaaactctcttgatcacaatttcttctgtggcgatggtctcatgtcctgctctcctttttggcaaaactccttaaaagacttgtctaggctcatgcctccaaatcctattctgctattatttcctggaaatatatctgtcaggccttcactctcatcattactttgcaacttttcttgttaaggtctccaaggacctctgtctttttaaacaaagctaaattctgtcttcattgtatttgacatacaagcaggatttgacacagttgatcactctcttttcatttagaggactccacattctccgggttttcctcccatatccctgactatttcttctgtatcctttttctgtgccctcctcttacctttgaacacttattgttggagtgctctggaactctctttagaggactttcctgtatctacgctcacgcccttggtgatattttacttcaaataccaattatacacagacaatactcaaatgaatttcacaatcatatttccaattaaacacttaacatgttttatatatatatataaaatattatttgaatttaattatctttatcttcacatcaatacataataatctatcagcaaatcatgttggttctattttcaaaaatatccatagtctttcattcttcctagattcaataattcctttgcttgtctatttagttttctatatgtcattaatcttcctcatgctgacgtctttgctacatgaatatatacatatatatggtacacatacatatatattttatgcacacacacatacatatttatgctcaaggacctcctgccctgctatcagcctagagcttttcatatacctctacatcctcatttcctgaatcccatgccttccattcttgttgctgttgtctgtttactttctttttgctggaactatattactcaatagcttcctgatataggaagttaaagttttgaatccttgcaaatccagaaaatgtttgtattctttctttacaggcaaccgataatataacttagcatagaattctggattagaaataactttactcataatttggaaggtaccattcttagctttttagtttactataatgttgcagaatactgcagtgatattctgtattttctatgtgacttattttattggtctctggaaatttttgtttcctttttatttttggaatttgaatgcttcatgagattgcaccttgatctgggtttttccaccagcatgtggtgagccttttttttaactttttaatattttatttttaatcaatcaacacataatatttatacctattatgggatacagagagatatttcaatacatatgtaaaatgtgtgagtatcaaatcagtgtaattagcaaatccattaccaccaacctgtatcatttctttgtgttgggaacattcaaaatcctttcttctagctatttgaaaacatataataaattgttgttaactatagtcaccatacagtactataaaacacaggaatttattcttcttacctatctgtgattttgtatctgttaaccagcctctccctatccccttctccctgctatccttccaagactccagtaaccactattcgaccttctactttcatgagatcaactggtttagcttccacatatgagtcagaacaggtaatatttatctttctgtgccaggcttatttcacttaacataatgtcttccgggctaaacataatgccctctaggctaatccatgttgcttcaaaagacagagttttattccttttcatggctgaatagtatttcattatatatttatatatgtgatatatgatatatatatatatatcaaattttctttatctattcctttgctaatgagcacttaggttgattctatatcttagctattgtaaatagtactgcaataaacatgggagtgcagatatctcttcaacgtactgatttcaaaacgtctggatatatgtacccagtagtgggattgctgaatcatatggtagttctctttttagtttttttaagtgaccttcatacttttttccataatggtatgctaatttacattcctaccaacagtgtataagaattcccttttctctgcatccttgtaagcatttgttattttttgtcatttttataacatattttaactgggaaaagataatattgtggcttttgtttgcatttgtctgatgattagcaatgttgagcattttttcgtgtacttgttggctatttgtatgtcttcttttgagaaatgtctgtccagaccatttgcacctgttttaattggattatttggggccattgagttgattttcttatatattctaggtattaaacatttcttggatgaataccttgcaagtatttttccattctgtaggtcgtctctccactttgttggtagtttcttttgctgcgaaagggcattttagtttgatgtaattccatttgcccagaccaatgtcctgaagcacgtctcctaggtttacttctagtattttcatagttttgggtcttacgttgaagagtttagtccattttgagtggatttttgtatatggtgagagacgggggtctattttcattcatttgcacatggatagccagtttccccagcaccatttattgaagaggatgtccttttcccactctttgtttttggtgactttgttgaaaacccgttggcagtaaataggtggatttatttctgggttctctattctgttccattggtttctgtgtctgttttacgacagtatcatgctgtatagctttgtagtaaattttgcagttaagtagtatgatatcctcagtcttgctctttttgaacaggtgactttgtctcaagattgatttgtctagctcagtggggtggctcacgcctgtaatcccagcactttgggaggctgagttggacagatcacttgaagtcaggagttcgagaccagcctgaccaacatggcgaaagactgtctctactaaaaattcaaaaattagcagagcatggtggcgggcacctgtaatctcagctactcaggaggctgaggcaggagaactacttgaacccaggaggtggaggttgcagtgagccaagactgtgccattgcactccagcctgggtgacagagagagaccccacctcaaaaaaaaaaaaattgctttgtctattctgggtctttatggttccatgggaatttaaagaattttttcttctatttctgtgaagaatatcattagtattttgataggaatcatattgaatctgtagattgcttttgataatacagtcatttttataatattagttcctctaatccatgatcatgggatgcctttccattttcttatgtgtcctctttaatttctattataagttttatagttttccttgtacagaacttttaccctttggttacatttattcctcagtatttttgtttttttagctatcgtaagtgagatttcatttttacctagtttgtgcttgttgtataggaatgctactaatttttatatattgatttgatatcctgcaactttattcgtttagtttatcacttctaagagttttttggtggagtgcttagtttttattacatataagatcctgtcatctgtaaaccagaactagttgacttcctcctctccaatttgtattcctgttatttctgtctcttgcctaattgctctggctaggaatttctagttctaggttgaataaagagtagtgaaagtgggcatcaccatcatgttccagttcctagaagaaaagttttcaccttttctccgtttaataagatgttggttgtaggtttgtcatatatggcctttattattgaggtacatttcttccatactaatttgctgacagtttttagcataaagggatgttgaatttcatcaaatgctgtttctgtcttttgagatggtcatatggtttgtccttcattctgttgatatacttttatttatcccatttattcaatttgctcatattgaatcattcctacatccttggtataaatcacacttgatcctggtatgtaatatttttgatgtgctgttggattcggtctgccagtattttattgatgatctttgcaactatggtcatcaggaatattggcctgtagtttttgctgttgcatatttggttttgctatcagggtaatgctggccttataaaattagtttagaagaatttcctctccttcaattttttggaatagtttaagaaaaaatggtattagttcttctattaaagtttggtagatttcagcagtgaagccattgatcctggacttttctttgttgggagactcttaattactgaatcaatctcattacttgtgagtgttctgttcagtgttctattcctccttggttcaattttggccagttgtatgtatccacaaatttatccatttcttctaggtttttcaatttgttggcatatagttattcataatagtctccaatgatcaactgtatttttgtggtttcagttgtagtgtctcctttttcatttctgattttatttgagtcttttttctttttttctcagtctagctaatggtttgtcaatattatctttcaaaatatcaactttttgttttgttgagcttttgtattgtttttggtctcaattttatatccttcttctctgatcttttttatttctatattgtgccttgcagaggacctttctagttaaatacatttgggaacttttgagcttcctggatctgggtatctatgtctgtcccaagacttaggaagttttaagttagtatttcattaataagtttttattaccctttttgtcatcttgtctttctaagctcccacagtatgaatagctgtttgcttaatggtgtcccacaagtcctgtaggctttctttattctttcttattctgttttctttttctttctgtctgcttgagttatttcaatagacctgtctttgagttcataaatcatttttttctgcttgatctagcctgttgtcaaaactcttgattgtatttttatttcattaactaaattgctcagctccaatatttctgtttggttcatttttatgataccaatttcttgttgaatttctgatttagatcatgaattcttttcctgatttttttcagttgcatatctgtattttcttctatcttgctgagtttccttaacatcattattttgaactccttttctggcattttgaaaatctcttttactttggggtctgttactagaggattattgtgttcctttggtagtgtcatgttttcttgctttttcatgtttcttgtgttcctacattgatacctgcacatctggtaaagtaattgcttcttttaatgttatggactagcgcttatagggaaagatttactcctgtagataagttctagagtgttaagtagagggtgataacttgggtcctgagtgggcacagtagtgtagtctctgtgaagtttcttcaactgtaatccatgtcagtaatgtttgtgaatgcttcactgacctaacctgtgggagtttgtggcagcagtgacatgactttactggaatcaggcttattgagtgagttatcaggatggaggcatgtttgtgcatgtgatgggtcacctagcttaggaactggcttgctttgggtgaagccgtgggctgtttctcaggccgggggcatgagtgttcagtggatcagctggttctggaactggttcaccaggagtgaggctgttgggtcgtttctcagtttaggggcataggcacatgttggtttgccagccattaagccttttaaaactatggtttcatgtctggaaaatgtgtattttatactaattctttattaacttattcctttaattttttttccttttggtgtatttctgaaaatttgttttcatctcattattattgttagcctttctgatgtattttcttatctttctcttctaatcttttagttgagatttttttccagcctttttttttttttttggatatagaatcttagtatattgtctaggctggactcaaactcctgggctctaacaatacttctacctaagcctcctgagtagctgggactacaagcacatgccactatgcctggctgtatatttttaatatttaagaattctttctttcaccaattgtttattcttttaggcttttttttgtttctatattttttaatgaatgcaacttttatcttctggggataacagagatattttattaaattgttattagttgatgatttcttccatctctaattccctgcattgtttgtttcctcatctggattatcatttttcatcctcctcctttatttttgtttctgtcattcacattgtatattttgcacatttgatgaattttgccatctgctttattctgtagagaaatggtaaaacatttccaaaatggcctttactcatgtttatgagcagcaatacagctttactttgcagaggttaaaagctcaaatattagttctagagttcttatctttgtagtatttttctgccagtttcctctttatggaaaataactctggctcccggctttctttaaactgtgtagaaggggagttgtggtggtaaaggggagaggcagtgtatacagactttcacttaatcctttcatgtctaccttgtgcctcttccaataacaagttgttgatgttccaatataatggagctggttaatttcaattattcttgacaataagactgatgtcactgtggagtaggattagtttggctggctgagtggggttgaaaaggggacctgaaaatctaaatactttctatgtggaatacctctaattcatgattctcaaccttggcactatggctattctgggctgggtaatttgttgtgagggatggatatgtgcattgcaggatgtttagcagaatccctggctacatatcagtatactacatgccagtagaactcctcccctcactgggacaaccagaaagttcctctggggacaaaatcttccttagctgagaaccattgtttaactttagacctgtgtgtgtcctcttacttctctcaatgtttcattatcttcaagtcttaaggctctcaaagattctataggaaaaatcagttttcatgttttaggaatccaattcagctagcactcaagctgtaacttctctgattattcaagaatgttgtcaatatttatttctatttcttaatttcattttctgtcttcaaaatttttgtaaaatgtatttcttccctattgatttctctgctggcctcattaaaattatgggttatattttttaaaattcctatttttttaattgaagtatcaagaaaaagaggaaaaggcacatgcttgatctgaactttatcaaaaattggtaattgttttcatctcttactattaactcttttttaaatcgatcctcttgctttaggaatccaaatcagcctgcactcgtactgcagtttctctgattagtcaagaacgttgccaatatttatttatatttcttcatttcatttttcgtctttgaaatttttgaaaaatatatttctccattattgttttctctgctggtctcattaaaattatgggttttacttgttaaaattgctgttattttaaagtagtgagaaaaagaggaaaatacatgtgcttaatctaaattttaccaaaaattttatattttagtaaatgtattcagatgcatatttttctgacaatgggcagtcttagttaacacctgtatcctttttcttgagcaagaaaataaatttattataatttttacttattctgccctagtattcctcatggataaatcgtgtcttaattttattaatctttgaatgcatcaattctaataagttggatcctttgtcagaaagcagaatgtgtacaatatacttatcccttagttttgtcttcctgggaactggctcttgatcacaataggatatatacctacagatcagcttcattataatttaatttactgtatttggcagcaacatcttctagtggtaacctagaccgagatgaaatattccatttcaattgacagttataaagctacagaccatagatttcagttatttgagtagttactacattaaaacacatctttttttcccttcctttgctcccaaccacatgtgcagcaaccagtatgtttctaaattttgctcctgtttataatgctatttcttaagcttctaaacatcgcagtgtgcatttcacctctgctaatctccatccaaattctgctatgttttggagtttgtaagaaagtgtagtgctgatgaggggattgaagtttcaggattccaattttggctgcttaacaggaacagttgaaggatggcatgaggtttttgatccatggttttccatttccctggtatagtaagcataggtatcactgccaaacttctttggagctctatgttatttgggttgagagcttggagctatgttaaacagctgaataaatgtttcccaatgcagctctgtctatgatgcagctcctgaaaattctctctgaatgttgtcaactagttttctcttaaattgagtttatagttgttttgtcaggtccaaatgtctttttgagactttactttgactgaacattgtgatagaatttatcctcctgcttgaaatgataaaaatatggacaaaatgtattaaataattgtttgctagatgttggacatcaggcaatgaggacaatgtttgctgagaaataggaaataaattatgtgaatcttacaattgacccggattactgcttacagagtatttctagaccacgacttagggagagaaatcccagatggagctcagagagttctccaaattgaagagatatagccaagtgtttcaggaattcaaagtagttagagtttgcagagagcagatagaggaacacagagataatttcacagatctacagagcatcttccttaagaattcactttactacggttcactgcatgtatgaggctgcagaaagcacaactttcaattattaaaagtaacaataattaacactcatgtaatgctgggtatgtgcctatttccactagctgaactggcgagaaaatttatgattcgtgggatatttgataagagtacacaaaagggtctagcctcaacagtggagaatagccctaggctgataactacttcaataccacctaataaatcttaagagcaagactcaaaaggaactgtttccaagtaatttaactgcatccaagaacaaaacacaaatatatttgtaagaacactgaaatatgtagtacctaacaagaaaaaattcacagtctctggcaccaaatcaaagattatcaggcatgtaaagaagcaggaaagtacaacttataatgaggatgtaaatgcatcaatcaaaattgatccagaattgtgagaaatgttagaattatcaggccagtatgttgaaacagatattacaactctacatagtttaaaagctacataaaaatatggaaggtactaaataaccccacagatcaaaattccagagaaaaacctacactgtatggaatgaaaatacactggatataattgattatacattaaacataaaacatttatgttatatataaaaaattagtgaacttgaagtcatagcaatataacctatccaaaatgaaacagagttgaaagagcatttgtaaaaatgaaaacagcatttgtgagctgtgggacaacttttagaggcttggtatatgtgtaattggagtccctaaaggaatggtggggtggaggtgggaatataaaaaatattcaaataatttatggctgaaaaattccaagtacagtacactgaaaaccataaagccacaaacccatgaatctcaagaaaactaaaaaataagtaacatgaaggaaatcacaaaaggcatattataattgaattgctcaaagctagtgataaatttttaatgataaaataaaatactacagcagccagaggaaaaagacgtgttaaatacaaaggcaaaacagtaagaatgacaacagatttcctatccaaaataatgcaaagaagaagacagtggggcaacattcttataactatgaaagaaaataaatagtgcacttatgattctatatctagtaaagatatctaagatgaaggtgaaataaaaactatttgcaatacatataatgaaagagttcatcacacagaaacctatactataagacacattaaaaagaagtccttcagtaggaaataaaatggtatcatatggaaatatggatctgcacaaagaaacaaagagcacccaaaatggcaactgcattggtaaatacggagggtatttttctaatgatttaattttctttaaatatagttgacagtttaaaaaataataataatatagtaaaagttttataacatgtgtaagtaaaatgtttggcagtaataacacaataattaagagggggaaaaggaagtacccttgacccttgaacgacatgggagttaggggcactgattccctgcacagtcaaaaattcaagtttaattttgactctccaaaagcttaactactaatggcctaccattgaccaaaaaccttactgataacatgaacagtcaattaacatttattttgtatatattatttactgtattcttaccataaagtaatctagagaaaagagaatctttaggacaatcataagaaagagaaaatgtatttactatttgttaagtgaaagtggatcataaagatctttgtcctctttatcttcactttgagtaagatgaggaggaggaataagaggaagaggagagattggtcttgtggcctcatggctggcagaggtggaagaagattcttttataagtagactcatgcagtgataacccatgttgttcaagggacaattgtataccgttgtaagatccttatactctatttgaagtagtctgtcacttaaagctaggctgtgataaagatgtaggataaaaaccactaaaatcataaaacaaagagttataactaataaaccaacatggagataatttgaatcataaagaaatataaaataacacaaaacaggcaaaaaaaaaaaaaaggaaaaaagaaatcccaagcagatgggacaaataggaaatatcaagataatagatttaaacataatcatatcaataataatgctaaatttacatattctaaatactccacttaaaatatacagattggaagattggttaaaaaaggaaaaagtacaacttaactatatgctgcttacagaaaagatatttaagtataagacacaactaggttaaaagtaaatgttggaaaagataaatcttgtgaacactaatcataagaaatctagggtgactttattaatatgagaaaacatgaatttttagaaattttgtccaagataaaatattgcccaggatgaagaaagtaatttcattttgcaaaaggagtcattttgtcaataggacataacaattcttaatatttctgtaccaacagcagagcttcaaaatgcacagagcaaaaactaacgtaactgaaggagaaagtaaaatccacatttgtcggcaaaaatttcaatacccttctctcaataattaatagaacaaactgacaggaaataagtaaatctatagattagaacaacactgtcaaccaacttgacccaatggccagttatggaacattcaacccaacagagcagcaaactacacctacttttcaggcctacacaaaacatctaccaaaataaatcaaattctgaaccataacacaagcctcaatagatttaaaagaattcaaatcatataaagtacattatggggctgcagttaaattaaattagaaatcaataacaaaataacctggaattactctaaatatttggaaactaactaacaaaattctaaataatccaagattagaagaggaaacccaaagaggaattaagaagtattttgaactgaatgaaaatgaaaacacagcataacaaaattgtgagatacccaatatggcaggacttagtagtatattaatagcactaaatgcctatgctaggaaaggatgaagatttcaaagaaatatcttctactttacaaaactagcaaaagaagggaagacccaagccaggctaatgaaagctatttctgagtttctaactgcatctcatggggatgatcatttcttttctctgctcttgtggctgaaagcatgttaaggccaaaattgtgattcaggcaagacccaaatttataagaccaagattgcattttaagccataaagagcaggagaatctccatggcttgaactgtgaatagatatttgtttgttatcagagatagtaattgtactgctttatctgtatttccttccatgttagtaaaagaaagctcagaagtagttgatcacatgatcatagagaataaactacatttctcagtctccttggcagctaggtgtagaaatgtggtttaagttctggtcaatgatattttatctattaacgtttgctgtttaagttagtggctaaaaacaataaaaattgcgtatttatttaggattctatggtttggctcagtgctggtgtgcactggcttgtccaacctcttctgggctctctcatttgtctgtgattagctagctggtcaagcagcagttagataggaagacctcactctcatatgtggtggttggcaagctggctgttcactgggacagtaggagcaattattagctggggcacctcagttctctgccatccaacctctaatattccagcaggatagcatgagcttgctcacaaggtgatctcagagttccaagcccagcaagaaagaatgaactctaaatttgcaggcattttaaattgtctgtttgaatcatatttgcaagcattatatgtgctagtatttggccgaagaaaaccaataggtcaatctagagttattgtggaaggatcgtaccaaagagtgtcttagtgtatttttaaaggaaaggggaatgcctttctctctttctacttcttggtggacagcaattggttttagagtatgagtagatttgtattttctcacattaaaaaggtagaatctacaactgtggaatctatagaagtaaactgggtattttcagttgaatcttgggaaactgactaaagttaacatttttaaaaataataatgctttattttatttttaaactacattttaagatatagttaatatacagaaattataatctatatgtgttacagagagattaatgaaatgggagtaaacttgttattttattaatttgtggcagagttcatatagaaagaattgtttttattgacaaaaatatctcgataagacttaggttttggcaagaatcaaggcaatattatacacttttgagatgtctgtgaaaaagtgaccatgtaaagtcaggtgtatagaaaaaagtgaatatgctttatagcagagcaaggaggaagaagagagaagccacagaagatggtagataattggagtgcaagatggtaggtaattggagtgccaatgaaaatctctagctatagggaaactaaagggatattatgaattgcaaagtaatgatttaattcctcttttaccccgaatctttaataaggtttaacgactacaatttgtttgtttgttttgaacaagacttcttgaaattgaggcattagctgagtttcacctctgggtgacatagggcagtgctggcagaagccagaaagacttcaaaatggaagaagcagaagtgtagggtcagggcgactacgaaatgatcaatacgcatagaattcttataaacttaaggaggacttctgtcattcagggatggaattagggtcataggctgccttatctagatttcaaaaggcaaggacgctccagatgatacatgcattacatgtaaataagaatacaacaaggccaggtgcagtggctcaggtctgtaatcccagcaatttgggaggccgaggcggacagatcacctgaggtcaggagttcaggaccagcctgaccaacatggtgaaactgtgtctctactaaaaagataaaaaattagccgtgcctggtggcccagctactggggaggctgaaacaagagagtcacttgaacctgggaggcggaggttgcagtgagccgagatcgcaccattgtactccaaatttgcaggcatttttaaatgtctgtttcaatcatttttcaagagttaaactccatctcaaaaaaaaaaaaaagaaaaaataacaaaacatataaaagataaaggttttgcacttttatttctctttaccttttgcacacttccttgctctttgaaaaagtattgtttacatgtaatgtttaagattattctttgacggaaacatcacatatgtccaatgccttaaggtgtttactatctctttggagaacaggactgatcctgtaaagtaccagcaaagactcaggcctgagttatgggttgatgtacttgaagtgttacaagtatgtacccacacgcctattggattttcatggtatgcctatatgttacacatatccaccaataaatgccatctatttttgtaggctgaatcaaatctctgtcttgagtaatgattttgtatcctttggactagatctgaataagactgagaaacagccaggcacaagaaggcaattcattgttctcactcatctttctaaacctatatgcatctttgatattgaggttcattattagctacaactacatttggtttgcatataaccatttatttttcagtcttagatattttcatatcaattgtcttaattatccttaaataaagcttccagtgagtctctatttcttggatgaggacaattgaggcagtgatagttctttaaaaattatttaatttctaagtccttcactatatcttgtaactgaatcccaacctagatatttttaaatatccttgaaattaaatataaatcaaataatatctttccacatgtaggttacttccctctatggtaactctgcctccaaatgtgaagagctggattcaatccaagtgaaagaaaatcagtggggaaaatgtcagggactataaaagagatttgaagtctgtacccacattgctgtgttagagtcctgagttattaaatttctcatatttatttgacattttatatacatatgtccacttatgaagagtttagttcttatctttctttaatcaacacagtattaactatgcatgtagtagatgaacactgtattttatgtatttgcattcttttcaaaccagatgcttaaagaataaaatgacacagtgttttagctgttattttgctttaaaatgctttaaaacaagaaacatttttggaatttcttatcacaatataaatcagctaagtatatttaatgtggtgaaatgaatcataaataggctgaaatagtcctaaaaggggagttgggtaagaaaaaaatgtattaggatcaatatcaataggcataaataattctattaacaaataacattaaacattgttacactgtttatgggatgatatcattatatcattatagaaagattctcccttaatttaaatacctagcatgtacaaaacaagtttaaatcaatgagacagtaaacaagaggaataaaatagagaggtgggctgggtgcagtgattcacgcctgtaatcccagcactttgggaggccgaggcgggcggatcacgaggtcaagagatcaagaccaatatggtgaaacctcgcctctgctaaaattacaaaaattagctgagcgtggtggcgggcgcctgtagtcccagctactcggaaggctgaggcaggagaatggtgtgaacccagaaggcggagcttgcagtgagccgagattgagccactgcactccagcctgggtgacagagcgagactccatctcaaaaaaaaaaaaaaaaaaaaaaaaaaggggaagtggtgtcctaaagactaaattaactgctgactattttctattttcagtctctacatatttatatttttatttctttatatagcattgaatggttaattccccatttcccttttattcttatacgactaacttctatgggttttattttcattcagttctgtatattccccctgctgaagcctcccatgttgtgtgtcaagaggaaaaatatcttattaccttcttgtctgttgaacatttagttttcttctccctccctccctgtcttgtacctaatgagcaaattatctaaaaatagatacgttcatcattctacaaaatgttgtatcttctctagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattggtacgtgtaacgcaaaagtttacagtcacatctctattaccatctggaataaaattctctatttgatttcttaactgaagagtaaagcaaatttctttgctcaagacaggctggaaaaaaaaacaatttggatgaaattaactgtttaaaatgattaaattaataattctatcaaactgcagcttgaagcttagtttaatcaaccctttagaagtttctttattctgtagatgcattaattcccatggtcccatactaataagtcatagaaaaatataatttgcttactgcatagatgtttcttttagaaaattagcactttttcaaaatgttttacacttaatgagttctaagcaaatcatttccatgctagttttcttaatagaccaaaataagtggattttttcaaaatattctgtgctacagggtcctttgtgataaatctttccatttttttctgttatatttctttgaactgttcctatgaaatgcaaaataagtcaacataattctacagatcatgtatattgctagggttacttacaaagggctacataattttaattttgtaattcagcaccaagttgattataataaacagctgccttcggtgttatttatcatttttttatacaagacgtgcttttttgtttgttactcccacaggtatttttcggaaattagatttgattatagcaatttattacatccaacatttttgaggggaaccaccgccacataaggacaaaatttatcaagtgcctaaaatgcactatgttcataatgcactttgaaattttgatatatgagaatattatgagaggaaagtttcctgatgaagtgagccctgtattgtaactgaatatgtcttggttcctataggaagtttaaaaaagacctttgcctttctattgtcattcaagacaccaagtcatccatggtttttctaacactgacctgaaccttacaatagtaaaaatatgcctggcagtgattacacacactcctctctctctctctctctcacacacacacacgaatgcttacatgtacacatgcatatgtacatatcattctgaatactattttcatttctgtgatatacctctaaatctaattctttatcttttatttatgtaagtgtacatcatgctacacaattcagctagacaagcgtttcaatttaataaagagaatgtaggtgtgtttagtggcattacacgagatttctctggtttaaagaaacattacatgaaaatctgtaccataatttacctatatgcatctcaagcatacagaaactaattttttagaaagaaagaataacgtgtaaagagaagtacatatttgtatgtgctatccatgatgctgaaggaattctaagaccctgaattcaatttgtatggcatcctttgttctttaatgtgagatatattttaaactcaagatgtgaaaacaaaagttaaagcaagacctttaaagacagtgaaataattacttctttgtatcaatggaatctttcttgtgatggttagattccagagcttgaggaagggaaaaatcaaaattaatttagaatgtataatgccatccctactatttgcctgttttgttgattgatccagatggttttctgcaggaaacataaatatatattttgtgaagactaaattacttcagtattataaataattattatttctagtgttatttctgcaaatgtagtactttttataaaaacaaaaacttgatatgcatatatatttactttcctaatgggatcagcaagtaactttattcaatttcaccttgttaatatgaaaaaaaaagaagcccagaaaatacaagtgtatgttgtatacgcttcagaaagcaaactgttagagttaacaaaactgttaaatcttactaatgattctatcaccagtaaaatacattagcaccaataattttattaaagtaggtcattcatctagaataaaaagggagaagaatgtgaattaaatgccaagtgtgctaactcgcctgtacttgttaacaccgaatgtgatgccctgtaggccttcctgactatcgttaggaatagattacctgtcaggaatatgtatggcatattcaaataagcactgtgcatatttttaaaactgatatgatatgaatccatgtagaccaattttaatagttcaaaatgagtcataattcttgttaacaatacagttatttttaaaatttgcagcaatagtggtccttttttattttccttattgaaattaaatgatatgccttaggtgagtcattcatcactgttaaagaacttgccttcattggagttcttgaatttttatccatatatatacatatatattatgtatttccttccagtttaggaaatgcttttctacatatgagttcctgagtatgtttttgactcttattttaagattaatttttaaattgcaattatagcttgaaataaatgtttcagttgattcaacccatgcagtgagttatttaaattcatggatatttggaaactatctaaaggaagtattttgcatctaaacatttactattctaatttttttatttctttgccttgtaatacccttttatcttttagaataaccttacttgtcagagatttaagtttaggtgataaaacatttttcttcattcgtaaaatgtatatgtgtactcctttaaatagaagtaatataaaaaacagaatttacttagtgtttaaagaggtatgttctgagtcacacaagatgacaagcaatgtgattgctttatgagccaaggagagcatgatttatattaattgaaaatgataaaatagaggagcatacaaaaggattaaaccaaaaattgccctggataagttttatttatattaattacttaaatgtgtggattcagaaataagtgtatatgctgttttcacaaaaatagttatcagctgacatttttttcttttttcccagcttcacgaaggtataattaaataaaaattgtatatatttatggcagacaacatgatgttttgatatatgtacacattataaaatgattaattccagctaattaatgtatccatcacctcatgtacttatcatgtttttggggtgagaacatttaagatctaatctcttagcaattttcaagtatacaatacattattattaagtatagtcaccatgctgtacaatagagctccagaacttattcattctgtctagctgaaactttgtactcagcttaaccttttattaaacatctttagagatttcttatctttagaaaaacaactaatttgttatatgtaattctactataattttaaatgagcacatttgttaaaatagtttttaagatttgttaaagagaaaaagagctccagcatatgtaacagaaacaacatttgcattaagcatttttctttgcattaagtaataattaaaaatttatgaagttcatcgcaaacagttgtatattaaagctaaattaaatattgtcattgaattttgagagtaagattggccccctatggcattgcttgtgagaaaacactcaatattttgtgttcgtatcatctgcagtagcattgtttgtgtctcgtctatcttgaatgaaatcattttcccatcctcaccttttaaatatattttatctttagggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtaagaaagaaatgtattacattttcagtgcacaatgacattccttttgttaacttaggtaacttctccctgtttctggtttgtggcttctacaaattttatttccaaaatcattactgtatttatatcattatccaacacatatataactatttaacttattcaaaattatctgcatatttatgttactattttgagaggatactttagataaaactcagccgatcggatttatttcataattgagactcaatttctacacttgaagtaaatctcctttttaacagttttttaaaaatcagatcaacaagagtcaattttattttccagagaaaggaaaatttgagttgaatatccatacaatgccaaatattcaaatgatgaactaaatctctgaataaagctggctaaatgtttttgctgaagaggctatatgttctagttttatatagaaatacctagaattgtttccacatgccatcaaattaataaaataggccactgtttaatctcattatatacaaacttatctttccatctctttcccaattgggagagggatagaccccatctatggctctccttacatttaagattttaactaaaatactataccttctttacaataaattcattatgatatgatgataaatataagtacttatccgttgtttaacagctgtgctaattgttgtcctgtcagccaatattagctctgagttatatgggtctataaaaatgagcatgataccaactcaaaagtgtgatttgcttgccagagaaggagtagaacaaaagttctgttaacatagcaaagaatccagcctaggataattgggccatgcttttcctttggcattggtcagtgtgtaagatcaaagagacaagaaggaattgatgaagagttcattctttttgtgatgtaagtattaaaaaacaacttgaactggtttaaacataaatggagactatattataactagatactccataaaaacctaaggagaaggaccactgcagtcaggactcaggaattagaatgcttccactgatacatattcatttgtctctctctctctctctctctctctctctctctctctctctctctctcagaaggggactttacctctctctttctctacatgggtatatggccaccctatgtcccctgaaattgtttataattctaccaccagccacaacagagcgatttattagctacctcttagttataatttctagaggaaaattcgaattgactcagttttgtttggttggttacctctgagccaattcattgtggccaggggtgtcacgtacttataaaatgagtatagcttttagggaccatttcatcaggtagaagcaaggtggtaagtatcccagaagacaggaagattatggagacctgggcagacagcctaaatgacagatacagcacattcactctttttaccttcaggttaatcctttcaaatttgcaatcaattaactttttgatatcctaagatgagatgtttttttctcttttagtgtttatcaatatctctaattttggcaacaaagtcctttgtctcctacacagtcaaataaccatgatttatacatccttctttctaagtaaaccaaaacaagctaatagatcaaatgttatatccttttgagtaattatcaattgttaaaatttactgttccagtctaactttaattgtatgtataatacaagtcacatgttttaaacaatttttctgattttggaaaaactctgaaatcatagttacaaacatttgttccctttggtccttccaatgaaagacccaatccatcatctcaatactttgtacacctaccagatatctaaatgatgaactaaaattgttagaaaacctttgtttttctggttgttttgcatatcattgcagaaaaagccatggataatttaatctacaccatgcataagactgtctcatttgttcccttcctaggatgaagaaatactgacttcattgctctttcctttatctttgtggctctcattgtggtgatctctttgttcccaactctaagcccttttctcccacccaaatctatggctctttcctgtctaccctatatagtattggcagaataattcccctaaagcacttaattcgttatgtcattctcctgtagggttaccaaaaatgggttttattttgcttatcatttgagtccaatctgggcaaacctttatgagtttttatcttccagtcgcagtctagacacctagctttgcttcctgatattccctttctcccatcttcttcagtcactgcagccacttcactggagctacacatgtcacatgcagagccgatttcaatctacctgatgctttggttcattctcctttcccgacatggaatgcagtataatcctccttttcaatgttagttggcatcctctgactagttttactactcaacatactgcctaaaattctccatcactcagtgaacaacaaagttgacatgagcatcagtgttttaagaggtggtttaactcaaacctatagaaaacttgaaaataaggtgtttttgaaaatgtgctcaagcttctattgtcttcatgttcaatttattatatgaccttgaagagaggtttatgttcaagaaataataatacagatctcattgtaattaccccataattatgcttcttttttctgaagaccatatggacctataaatgaagtcaatgagttaagagtagggagcattaaacatggtgaaaatatttttatttactgaaaaaattcaacagcgtattgtaaaatatttagtagaaaatgtaccagactgagaaaacatatttggagctccatttcttcagcttactgactctctaaaggcattcccctgtccttctctacagggaacttccatattttcttccaactgtccatttctagccaggggtaagcagatttatctttaagctgttacctgagtggagcctgtatcagttctactcatatcctattgatcagagctgctttgtatatccatacctcactgcaaaagaggctggcaaatagatgctctatctgaatatcaaggtatatatttaaaacttggggcctcttttattataaggagtaagaaagagattgatccttgaagacagccttggctatactaggaatgtcctacacctaaaaaaattagctggcagaacattagtcaacttccgaatagatgcttttaatgaccatgagttttgtacttttattgatagatcccattattatcattttttaaaaaaatcagccaaagttaatgaaggcctcttgagtcctgaggaaatatatgcacaaaatcccttcttgggatcttcgactgtttcttacatgctttgccttatagactcactgctattctagtcactcttccttccaaggacatgctacagtttatagtggccctgctgagttattgacccaggatattaacctggttatgaaaagctagaatgatcaagctacagatttggattattatattttgttgaacagtgcagttattttcatatagataaacatttctcttactgagaaatcattttcttctgggtactgttgagttcttaatttaatcagagaacattttatgtgtagtagcaaacggtactttcagtgagcttaaattttgatggggaaactgacagaataatttgcaaataaatatatgatatgaatttaaatagtgatgatttttggatctgtggctctactcaattatgtttctttcttgctaagagtttaagatattatcgaggttaccaaatagactatttatttagcacttttatatcagtgtttagtttccagaaaggtgaactgggtagccatgtttatattgtacaagtgaagtcacattgatattttattgcaatggaaacagtaagtggtttaaaaggaggaatggtgaagtgaaagaaattatcaacctgtttctttttatattattatctaaaactagtcatttttctgtttttctcttttgcattttttctcatttaagatcataagtgcctgttttaaaaagcagcccaatgagatgaccttgttaaaactcctgattatttctcagtatcgtcaattaaatgaaccccttattgtgtgcccacaatgtacaaggaattatatatacatatatatatattttttttttctttttttttcttttgagatggagtctagctctgtcgcccaggctagagggctagagttcagtggcgcagtctcggctcactgccagctctgcctcccaggttcatgtcattctcctgcctcagcctcccgagcagctgggactacaggcctggctaattttttgtattttttttttttttaaagcagagatggggtttcaccgtgttagccaggatggtctcgatctcctgacttcgtgatctgcctgcctaggcctcccaaagtgaggaattatattattattgtagttatgcaagttgaataaggtaatccttgccctcaagatattgaaactttaacaagggaaataagacatttgcacaagtaaataaaatacgataatactttaaatgtgatcattgtttttcagtattagtgttgatgcccattctacatcttcctctaaagaaaagaagacaatttgcaataaacctttggaaaggagttttgttgcgtctgtacttaggcaaatcgtgactaagaagttattctcctaatggccgcacatggtggctcatgcctgtaaccccagcactgagaggctgaggcgggtggatcacctgaggtcaagagtttgagaccagcctgagcaacatggtgaaactccatctctactaaagatacaaaattagctgggcatggtggcacatgcctgtaatcccagctacttgggagactgaggcaggagaatcgcttgaacctgggaggcacagattgcagtgagcagagatggcgccattgcactcctgcctgggcaacaagagccaaactccgtctcaaaaaaaaaaaaacaaaaagacaaatatataccagataaagtcctccaaaaaaagagccaggaaaagagaaaggagaccaggagggggttgcatgaagaaaatttagtattattatccagtattgccattgtttaacataatttgagttttaatcaaaatttacatttgcataatttaaaaaaccaaataaaatgtaaagagccctgccttatcattttcctaggaatttccgtgcttagagaaaacaccttcaactcctttagatgtttattctgggctttcatgtctgtaattctgggttttacatatatttcaccttgatttttaaaatgtagatattatctattgtcttcctcctatagaagatgaatgtttagctcctttcacctcctgcttagcaatccctttatttggttaaatcagtattcagagatttctttattatgactatataaatttactgtacagctatgccatataatatgatttgactatattttctttgctcaaaaaatttgtcttccttagtttttcaggactctctttggcatttctaggaaacaaaactctccaagggaactctgttcaagaaatctatcaggttttgttttttcccactagatatatgagtgggaagttcaggctggttgatctttagttctgttgcacagctatatccaagggctaacatttgctgctatactagggatttccttcccctgtctcctatgttggatcctccatttcctgaatcctacacgttctctcttcttggtttatttgtgtatttggtagagcacatgttctagtagcttctgaaaaagaatacaaggagggaagtaatttgaggagaaaattttgaatatctgaagtgtctttattgtctacaagtgtctaaacataaagaacgatttgaaattttactattatatgaaaacttttcattaaaaaaatttaaatggttgtaccattagctgttagcaatgttaatcagattctttcttcttttctacttttttttttttttttaacgacctggaagtttttaccatctctatatccctgggcactcagtggacccttttgcctatcagtgatggttcttatgttctgagaaaatctgcaaacacattcatagcaacatctagactcatgttcgaccaaacagttggacaccaagcctagccaagttgatgcataaaatcaacaatcacaagcaacctttcacataatgcctgtttacatacttgttgagtccagactttctttagtttaacttctaaaggaaaagcttactgcatcttcctgaagtgtaagagggacaacttcctggttggggaaggtatttagcacaccttatatctgacttcggaaatctctggggctttcaattccaaacctttctgtctagagttacacaacttgaataaattagcttattgtcgggctctccactgcaagagcttagctttttcttataggtatctataattgattgtcatttttctccttctctcttttttttttttttttttttgtttatttcatctctggggatttcaggagggaaacattattcaatctaccatgttttactgacaatgttcccctagtgtttttgaggttttaatcttttcagaccaaatctttgcagacatccttgagccctctcttttccccacaacctttgtctcatctaataaaaccaattctgctgattttaccttcaagtatatccagaatttgaccacttcttgccacccttacttacaccagccaggtccaagccaccttcctctgttcctggactattcaagtagcctcctactcccctttatctttcttccatcacttctcaacagacagccaaagtgatgctgttcaaacttgagtaacatcccatcactccaccttccatttgcttttcaccatagctaataagaaacaaagttgatattctttaataatcctcatggtctataatgtccatgaactctctgacctcatttccacaagtcttcagatcatttcttcctctccagccaacaagcctcattgctgtccttcacaactgttcaatgctctatctcaggcaggtataaaagtacctccatagcagtgctccctatatattttctgaattaatggataattatatttcaaaaatacctcagtggcattctcctgtttttaggtgtgagcctagcaaaggtctgtggtgtttttttcacaacacttacgaaaagcgttgtgttcaaccttgcaaatgaggaaaaataacagtgacctaagtatcatatattttttaacaaaacaagatatagtctgcacatattcatagcccacgaaaagagcaatgtgtgctttggggtggacatttttttattttttattttttattttttttgttttgcttcagaaattccactttaatgtttttttttttcctggttttatggtctcttacagtaaaacttgcattgaaaagagaaacccttatcctgaagtatctttatcataaacagatgtttgcagtagccagccctgcaatgtgcacagtaaaatgtgctgctacaatctgaagctttcatttacttatttaaacatgtctgagagacctagatcatataccacaggggcagacagcatgctggtgtgtgagcagtggggcatggagggagaaggatggggtaggaagggatgagtagcaagcttaaggacttctgcctccctttcatctgtgattgcaaatactgctgacccatagtagatgactgcacatagattcttgtcccactttcctaaaaaacattattaaggaaggtgcatgtaatgaaacctcatgtattattaacctaaccttactacgaatgtacaaggaataggtttaattcaagtaaaatttataggcaatttgttaaagcagcagtgcacattagaaggtacattagagacacattggttttaatatgccattcaataacttgaacagaggttaaaaatgctgcttaacctccattaagtattttaaaaatgctttaatttaaaattatttggagtgtgtgtacatatatgaatgtacacatatccacactaataaatataacactaaatatgttttcccagttccctttttcagtgctggatgaccttataatgttcagcagtaggcacttaatcagaggccaggccgaggaaggcagggaaggatgtcaacgcatcccgagccagtgacccacccttgtccttgagaactagaggcagagagtgcatattgaagactctgtagctttggaataaaacaaaggctaatttataatgaaaacagcttcctatgacatgttttgtactaatagggcagtgcctcctgcttccccctagtatttacttttggttttcttttacaattcataaaacaaagtatcttgtttcattaagtagcacatcatatttattaagtaatgagctcataaactagaattgtgtacaagaccctgccaatggaattggaatcagatgctgatgttccattaaaaatcaatgcatcaaagttgatatccaattatgccacatttcctagtgtttggtgagacaactttctaggttaacatgtttttcacagagagacctgaatctaaaagtaagaacctcttccttgataaatcatcaggaaggaatcttgtcacaggaaatacagaccacaatcttaggtacatctggaaaacaaaaaaaagtaaaagacactgataagaaaaatttctctgtcatagaaaacttgctaattgacaattacaaagatgataatagataatgtttactgagagtccgctgtgtgccaggctctgtgataaggttttgcctgcaaactttcatttaatatgcacaatatttctaagatggaggtgctgggattattctcattttaatctaattgggggaatgaaatctaattaagtagaagagccatttataagtccaggtccatctgactccagaatgtatactctgaaagagtggaactttttctttttctttcttttttttttttttttttttaagacggagtcttgctctgtcgcccaggctggagtgcagtggcacgatctcagctcactgcaagctaagagtggaactttttctaaataactaactcaatatttatcttacacattcacacaacaaatatttgagggtgagttagataaatactgtttatttcatccactttcaagcatacctcaactcatgattctggcttactgcttcacattctgggatacctcatttgttgttcaaaacccaagtagtaggcataaaatgaaaattaacagagtcctgggaaaccacagagttcaaataatgatgaggtaaattgaaggggtctagaaatggaattatctccgagaacttagttggagaaattctggagatggttggaatggcacaggagacaggctttagagcatgcatttgataaacactgaatgggaacagagaatataagttttgctgtggattttgaatatgcatacacatacatatattaattataatctccaagatgtaatcagagttgtcattatttgggttatttgttgttattggatttgattcttagagaatatgttaatgagggcctttcatgggtattcacataaatagaaaaattggattatttatgaaacagaaaattccaataatgttttcccttacatgagcatattattatgtcctttgtttaagagctaagatatagttttagggtgacattttctttctgcagctctgttccatctgttgctgtgacgagcactatattttaaatttattgtgtctgatccatatacactcctctctagactccctgataggacaggccactctgaccaaccactctcatgactcacagatttatgtttaccattttccttttcagtgttaaagggatcatctcatattttagaggatagaagatatttatccatctatccacccattcatccattcagctatctatccatttcattcatacatctgtttttcaataaacatctattgagtaaattaccagagactatgttggtgttaaggtatacaatcacaaatatactaagacattgtgatttagtaggggaaactgactcacatgtaaatgtatcacaatgtgatgagagccatattagaaatatacaatatagagaagtagtaaagtgaaggaaatgattaattcttgaaggatgaggggtcttaggaacttagagaaaatgatttctgaactgacttttaaaaggaaataggaatcagcaagctgctcaagaagggagtagcagcccagaaaaaaaaaataacagcagaacatttaaagcatacctaatttaattgaaaaacccttaaaaattgttttaaaaaagagaaattataccttgggatgaataatattaatatttatgtattcacttgatcaagtctagaagtaattttagcgtgattttatataaaactaccaaatggaggaaaattattattgttttaatttgaaaactaccatcatcaactatactgaaatatagtttacaaacaatacaacaatattgaaaatattgattcataaagccattaccaagatagtcttttgttgcatggatataggtgagccacccatccctccccaggctcttgtgtaactattatgtccattttctgccttaaggtgagagtagtttcttctaaatgtcttacaattagtgcttagccccagcattgccctcctttcttgaataaagcctagaggttacacttcttttctttctccctctcaagaccttggcaaagcctagttgttcatggtcctcaggagagacattgctgggaaatgggctcttcttttatgcccaggacaagtactgtgctatgcaaatagccgctgcaggagataataccagctgccttgctaataactttgaactctgtagattcttctcctaggcaaagccacactattttacaatatgggtgactctttgttttagctggatgatacatttttttccacttgagatttgtcatgtctaaaaccaagggtcagctaaataatatgggaaaataataaactagcgagctgatttggaccatgtatatgtgaactctcagcactacgtaatgcaaggtaataatgttgtcctaatgaccatgcttaagaatgtggtacaaaatcattcatggaatgaaatctcaatatgatcagttacaatgctacagatatataaagatttggaacatgaagaagagctaacaaaggggtatcagaaatgcattacattaaagtaaattgaggtcagttataattaagccacattcaggagttgatgtttaagtggaagggaagggaaaagattgttttctatagttggaagtcataaaaggaggtaatggtctagaattaggcacattcaggtaaggcaagaggtaatctttaagcaggaagttacctgagtcatcctaattagaactgcttaaaaataggacagctaaaatactggtgggattaacctttataatcaggctcctgagaggaggaggggaattaaccccaaggcaaattcccatgcagtcttttcctggaagccctaccttcactttcagtctccctaggtgctttagcatctttttagttcttctctgcttgtacttctgatttttctgtgacattctttattccccaaaacttggactacccaacttctgcaccaaaatgctatcccctacttgtacttacaggtttatctaatacatcatttcttctaaaaatcacccttaatttttccaaattctctgtggcttggagctattgcagtaagtctaaattaattctacttgtaagtatctgtgctaatgggtaatttatccaaattggagagctgttagcacattcatgatgccatcatcatggatttaagggcctagataccttcacaggaagaaaaatacaaagaatcacaaccacagtggccttgaatttaaatggaagccttctgaatttgactttgatcatgtgatgaatcaggtacaagaatatatactaattgtcatggccatgctctatttctggatatgtatatataagggaaattgctgtcaggtggtacaaataaacaaatagcgtaacctggctgtaaattatgataaaaatgatagtattagttgatttccgccaactgaatggcacatattttgagctctttcttttcctctcattgagcacaatgttttctattttgctgcccttgaaactttgtaagacagaatgtataggatctaggggaaggaaaaaaacccaattgttggtaactataagaaaatggcttgttttcaacaagagcctggaatgagttttagagtatcctaattactttttgctgttccctatataatagataagagaatagattcactttttgctcatgctctccttctttcaatatcattgctattttatgaactttaaattagtgtcatgacaattgtacaattcatttttatttgctgtaactgtattcattagaatccttctgtgatccttctaccccattgtttcagtaaaattctttgcagcattttgcacgggcttgtgtgtgtacccatgggtctgtgcatgtgtgtatatgtatatgtacacatacatgaacacacacatcacacaacactaagaaccatttctccctcatatgcctgctccacattcaactgcctgataactttctaattctataacagttaacttccatctcctgggtctgaagagattttaagtaatttgaataaacttttgaatcatatttgtatttctttcctttttccataagaaaaaaaatatgagttttagaggtaagctaaagtctctaaattctgcaggctttttttgtgtgtgtactacttgcagggctcacagcctgtttaataattgaactcatttttatttgttcatcgaatgtgtttggaatgcctactatgtgccaagcagtgtactggctgctagggagacaatgatgaatgaagcagatgggttttctgcccttatggaagttagattttggtggaaatgagattgattataattttcatgaacacttaggaaacaaacaggatgctatgcatttgtaacaggtatacctagcctggcctagggaaagttgcctgaggaagtcacgagacctgacttacatgagtgaactgagcaacagagataggtcaaaatcatcccagcagacagaacggcccatgaaaaggcctttaggtctcaagaagaggaacaaatatgactgcaatggactgagcggggggatgagccatgagctaaagctagagacgtagctgggacctgactgtaggattgaaagctgagtgagagatttggatttatttcctaaagggaataggaagtcatcagttagtttcaaatagagaagtgaaatgtccaaactgcactttggaaaaagactgctacgaagaatagattggaacaggacaagagggatgcaattagaagagatggcctccgggactgggtggtctgggtgtaaacctgggttttgctatccattaactctaccattttaggaaagtgtgttaaccttctcaatcttctgttttccaattgacagaatagatgtaataataattcatgcattatttgcatttctatgacaactaaatgagatgctcaagataaagcccctacagtagcatctagtttgaagtattagttataaaaaaagtggttggtgactttatctgggaggtcgtagcggggatgaagagtggaaggtttaaaattgttaggaggcaacatccataggacttggtaattagcaaaatatagggggtcagagaagtggaggatgcaagcttttgttttagtaaaatacagaattagtttaatttgaatttcagataactttttttagtctgagcaaatgctgcatgggctgcacctttgctaaaaaatttcattatttgttagaaattcaaatgtaactggcttcctatattttataagtctgccctaccaaaggtacctcagtgttctaggcaaagcaactgaatgactggtaatatctgttggaatggagctgattagaggaggtcaagttttttgtagaaatattgaaatattgcatggtagattttaaatacattgaattgtaggacctgggaggcacccaagtccaatgtagataatttactcagtttttctttggtcataattgacacactgaaggacagatataaccacatttgtattgggaattagtgccttggtagagtattctgtttttctgtgtaatcaattattatgctttaaataaaagagtggataaaaagtatatataaaacttttaatttctttatttctaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaaggtacatctttataagctttaataatttaactctttctttagcaacagttaactttttttggcagttgcaaagcaataacttctgtaaaaagtattttttttgcccggcttggtggctcacacctgtaatcccagcactttgagagaccaaggcaggcggatcacgaggtccgaggtcaagaggtcgatatcatcctggccaacacggtgaaaccccgtctttactaaaactacaaaaattagctgggcaaggtggcatgcacctgtagtcccaactactcagaagtctgaggcagaagaatcgcttgaaccgggaggggtaggttgcagtgagccgagatcgcgccactgtactccagcctgggagacagggcaagactctgtctcaaaaaaaaaaaagtgtttttttgttattgatatgttttttgttccgtgacatccacatttacttaatgtatgctaatctttgaatatttcctagagtgggttgctatatattgatagatgtggcccatcctagcatctgggaatgttgaatgagataaaatatattttctctcaaaaagctgagagtctggatgtggagaaagacaggaaaagacatatctgaagaagaaaatacacatactcatactttctctctctctctctctctctctctgtctctctgtgtatatatattatatatatatattatatatataatatatatatatatatgggatatatgtatgtgctttgttcttcattgcccttgaatttattgcatatttattagttcattgcatctatttatattttccttgcgtttctaatttagctttaaagactggcagatgagaaacatagctttgtattctgtgatatgatttttttcagtatgtaaagtatattatgaaagtaaatcatttttcaaagttacactctctttaatattctacttcttattctctgggtatctgtggccatttgccttcactcatttgtgtttattgctgtatttttgaagatgtgctataatgccaattctgtgtctgtgtgtgtgtgtgtgtgtgagagagagagagagagagagagtgagattatgagcttgtctaaagttcagactaaatctatgaattctttgaagctcctatccctgagaagctagtagtgtgtgctgaactcagaaagcatgtaataaaatgagtcaaatctgtctctcaatatgtgtatatttataaatctaattgctaattatttcagggtttgtgattatctgggctcttttaaactcattgcccccctgctgcctgccttttggctgttccactcctcattaacacctccattagagggtggacaggtgacagggtaattactgaaaaagaacttaaactagttcattttgactttcttttaaaatttgatgtgatttttaaaaactacaaaaatcatttaaaattttattaaaataatttttgttttcttgacatacatgcatatattttaatctgtgacgctctacttctatcaccgtagaaatgttaccttgatggtctgagaccattgtgactcttttctacagatgttattataaatcatctaaatgagtatacaaagcgcatggtacagtaaatagtaaataaaaagcactgtcaggattttgatagtaaaataggagccagttactgcacatactagctcctagatgtaatttttttgaaataatattctacagattccccagttggaactcttgggctggtttgtttcactcctggccacctctgtctttttcatagttctgaccacatttaccaggagaaaaatatcttccccaacccactgtcctccttgcaacactcattcccatcagtgccattttgtgacattcaattacccatttttgttctactcatcccctttgtcagtcttcccagggttatcagcaaaacgcctgctcagtgacctggggatgtctgattgtctcagctttttcacttaactttttttctttaagtgagatctgattcccttcattacactgcttcctctaccctacaatgttcttaaattcgtggctgagccttttaccccattctgttcctctcccattatctacccatctcactctcactccccaccttactttagtccaggaacaagaattgcttaataagtactgttccatcacctgtcactctgcagtaggcctgactagcactggagctagattccctgggttagaaggtggatttaaatgtttacataaattgataaggaataggaaggaccaaagaagtgggtataagctacatttttagaagataccgaagttacaataaagaaagaattcagtctaggcactatggctaactcatgtaatcccagcactttgggaggctaaggtgaccagatcccttgagtccaggagtttaagaccagcctgggcaacatggcaaaaccccatctctgtaaaaaataaaaagttagccaggtgtagtggctcttgcctgtagtcccagctacttgggaggctgatgtgggaggactgcttgagactggaaggtcgaggctgcagtgagtcaagattgtgccactgcactccagcctgggcaacagagcgagaccctgtctcagaaaaaaaaaagcaaaaaagagagagagaaagcagacttcagattcgcaaaaagaatgaggggcaggttggagtctagaaaatagagctaaagtatgagaagctgagtagatttctaaaaatatgaatgattcagattaagtgtggggttttttttttggacagagtctcacactctgtcgcctaggctggagtgcagtggcgtgatctcggctcacttcaacctctgcctcccaggttcaaaagattctcctgcctcagcctcctgagtagctgggattacaggtgcatgccaccatgcctggctaatttttttgtatttttagtggagacagggtttcaccatgttggtcaggctggtcttagactcctgaactcgtgatccgcccacctcggcctcccaaagtgctgggattacaggcttgagccgagtgtgtgttttaaacaaaaagatccacaagttttatataaatgagtttggatatctttacatattagttggctcctgttatattgatgggggtggtgagattacctttttaaaattacaaattgtccttggaaatggtcgcacttttcttccatccctgtattagtccgttttcatgctgctgataaagacatacctgagactgggcaatttacaaaagaaagaagtttacgggacttacaattccacatggcttgggagacctcacaattgcagtggaaggtgaaagacacgtctcacatggtggcagagagaagaaagcttgtgcagggaaactcccctttttaaaaccatcagatatcgtgagacttatttactctcatgagaacagcaggggaaagaccctaccccataattcaatcacctctcactgtgttactcccacaacacatgggaattgtgggagttacaattcaagatgagatttgggtggggacacagccaaaccatatcaatcccctttgttcttatctttccagttccaggttttccttttcagagggattctatttttctcccttttctaactcctgccattattttaaactactttgacatgtactgatgcagttctttggcctcttcattcattccccactccagcaacccatttccatggctacaccctggattttgtgatcacttataatttctctatttctcaaatcttcctaatcccatgaatgctattctatggatatatcacatctttccaattccaattcaccctggaagcctcacataacctgctccttaacttctcttaatctttatcccattatccctccttaatcctcttttgatcaaccccatccctaacttcactgtcttctacttctagcctgaggcaaaacctttttaattatgacccttttgagtacctgattgtgggctcccttctgctgtactgtggggtcagctccagagacgatcaccctacacctgccctgatctgtgaggacgtggggaaagatcatgtgcctatgctgatctgaagcactaccatgtatgtacttcttatcaatttactttctttccccctttaaactcctaccagtctcctcagttttaattccatgctcttgcccttgcagataatctggccctctgctcatagacaaaataaagccagatatatgtatctccagattatcttttctccacctccagcttgtctacattgtcacacatttttaattttttatctagtcttagaagaaaatcctgtgtatttttgcctaaaaataacctgttcccagtccttgatatgatcccttcctgttttcctactcttgttcctccattccatgatctttgctccatcaaatcctccctttattttaactcaaacatctctctataggtaatatcataactgcctacaaaaatgctattcattctacaaactccttcctttgattctgccctgctttatgagccctgaaagttattgtctaatctctcactcttcattcacttactaacatttaaaaagagcactatgattcaagaaaacatgatttaaaaaataaaagatcagattttttttcttcttcattttgtttctttctcattcattctttattcaccatgtgtggtacatacatgttagcagaacatacaagttagcagaacttgcaacatgcagacattcaagaactagttatgtgactattaaattctcatccaaatcaaagacaaggtctataaagagatataataaacaaaaatgggttaaggaaaagacagaatgagggaacaggtttcactggtgggaaaaagggaggggtcagtggtgctttccacttgagtccagtgagaaggtcttatttgatcccttgaagggtgacatgtgtctcctgcagttggagagaccagtgcattgatatctatcttagacctggcaaatctaactgagaagagacagtctacccaggtttggataggtaagctagaagacagtgccctgcatatcttagactcccagagttcatcatgacaaggaagactacgtatttctcatgaccggatgaagaccacaaggaagaaagacagggtaaggttgtcttagtctgtgctcaaagtaccacttagaagataaaggggcctgtgtagaataaaggacaagattactgtggactacaggttaataagcaaccagtcgaaaagaaaatgcatctgactgcactaaaacaaaaggtgagagatacctaatggtgagaaagatcaatgaagaagtcaggaatgtaccactgtcagtgataagtcagttttatgtatatgcaggaccagagacaatagactgctttgggtggttctagtccaagtgagtttctacccttcctgcagcctctacgtgagggaggaggctaaccaagctaccttctctgattatagacttgctgcctttatcatgtcctagcttgatgaaaggaagagaagtatgttcttgaaaatgtctgttctttaaataaagattggaatgttgactaatatacaggattagactttctattttctgaattgaatttgtattttgcaatgtaaagtaactgtaggacattctattgcctgagaaagaccagaaaagccaagtgactaactcattttatatccacatggaacatgggggaattagctccatattatatgtttaaagggtcagtgaaagacaaaaataaaactgatttatgattgcttctcatgacttatggtttctcaatgtgctggtcatttcattgttcccatttatttcttaaaattacctcttcctttggtttccaagattctacttctcttatttgttttctaactctttttttggctactcctttttaatatgtcctttcaatttccacaactgtgtccctgatttcaaccactacatacatgttaatggctttcaaacacatgatcacccattcagatgcctgccacgcactctaggcctgtagccagctgtctctctgagttttacgcttgcaagtccctcgtgcatttcatttttaatatagtcagcacagaactaaccattacttcctcatctccacccaaataaaaataagtcttatgccatctcatgctatcatcatcttggtgaaaaagacgtaaaacttcaaataattattcaagtccaaacttcccaagtttgagtggggcttagattcttctcaggtttggcagaattggctctgttgttgagtagaatgagtctacaggctactgctggaaagtgctatggaaagcaagagctactgtatataatgcagcttctctaaaaagaatagaaagaataaagcttcccatggccatatgggacccaaggagatcagcaggatttgtctcttactaaatcagtcgtgtggaatgctggtaacttgacttgaccctcctatcccactgatgaattcagctgtctcttttcacttcaacattgataatcattacacaggaaatcctgtagcacagaagggcatggagaaggatattttaaaatgtgacaatgagaattgcttgagtttggacttttgttcaacattgaaaagagataaaagtgggttctttttaatgtttttccattcctcttttgaatgataccgttcttgaatctttttttgacttctggttgttattgtatatacaccaacattggctatattgaaaatgtgtaacaattgactaagatatatgggattccatcaagtataagaaatttttgttttttaaaggaaaaaattcacatgtaatgtaaatatatacagatatgcagtataggaaaacagctatgtcctaatgttaaaacaatgtttttgaaaacaaagtagattcaaaatcatttgaatctactttgaaatctaggcactgtggtaggttattacaaatagaaatgtttacatttataaaaattacattccaattataacaaatggaaattaaaacattaattttcaaaatatacagtagattataagtaacttattattatgaaaggggaagatacaagtatcatattatttcttcatcaacttggaaaataacctcacttccttatctgcctggttcacatattccttaccttcttcatgctctatttgttggatatagcaaggtttgctatattgttttctcttggtttatttgctacacagttttttgtattcccaagggcaaaataaataaaataaaatagacctcggccctaaactacacaaccaacaacaaaaatccaggcaacacaacaatgactttttgtgaccaagctggaaaatcatttgcctgtttccatctaagtggtttattcttcaaaagttactgaccagaaaaagggggcatgtattttaaaaagctgatcctagtgcaaacattactccatttacctctgacacataaagcaaacatgatttaatcagtatcgaaaacaatgaagcaaaaaaaatctgcccactgaaaaatcaataatgcaaaaaagtatatagtgtttgtctaacccaaaaacaatgagacaaaaatgggccatatttaattcatctcagttggtagtggagacccatatttgacaccctgcacttactggcactgtcctcaagttgacctgtgactatgactactctcccccatagcccccaggactgctccagttcatctggtaccccacagttttcttacataacaaccacacatcacaacccccaaaagtttcttccctaatgatataccctctctatattctatgttaccttgttttaagccttaaggagttagtggtatcactatttgtcccatttactagctgacacacactgaagttgtccatagagggtaggacaccaaggctggttagggagaataaaggctcagacttctggagcataaaatacagggaagttcttctatgcccagattatttttggttttactgcaaatgttctacatttcagcactaggttatagatttggtccagtaatcttttcacaggcctttatccgattgatctcaattggtcttttctctgagaaccaggtcaatgacttcagatgaaagcagataacttccttgtcaactgatttccttttatggtgtgataatggaaaaattagggagtgtgcctcatagattccctctcctcagtgactctttgtcagacagctggctgtcatctggggtgacagggtaaatgggccacaagcctgtcatcatctggcagccaaggcagggctttctcacaaggcagtggcagatttccaagaaagaaagcagaagcatgcaaagacacttgaggcccgaaccgtcaggatgttacttttaccttattctactggccaaagcaaggcacgaggcttaaccatgtttggaagtggtggggaataaacagactctccttttgatgagtagaactaattatacagttagctgcaaaggacctgcacagagggaaaggtgaagagttgtgatttttgcaatctcctatggctgccaaactatatattctctcttagtatagatgatatatgatctgataagaagtatcagtttttatatattagtagcatttattcaacgtgatgtaataggaataacatgcaactggacatcaggatatccaggtttcagttttgtcttttccactagaccagatacagtagcttcctattattggtggaataaattatctcaaactcagtggcttaaaacaacatgaatttttattatcttatagttctggaaatcagaggctctaaatgagtttcactaggctaaaatcaggcctgtgtttcttatggagattctaggaaaaaaaaaaacatttccttgattttcccagcttttagaggcaacctacaatctttttttttttttttttttctgagatggagttttgctcttgttgcccaggctggagtgcaatggtgcaatctcggctcaccacaacctccgcctcctgggttcaaatgattctcctgcctcagcctcccgagtagctgtgattacaagcatgcagcaccacccccagctaattttgtatttttaatagagacagggtttctccatgttggtcaggctggtttcaaactcccaacctcaggtgatctgcccgccttggcctcccaaagtgctgggattacaggcgtgagccaccgcacccatcgtacattctttagctcatggctccttccttcattttcaaagccagcagagcagtgtttccttggacctctgcttatgtccttacatgttttctctctgactcttaccctcctgccttcctttataaggaccgtagattacattgggcattcttggataatccaggataatctccccatctcaaaatccttaaccacatctgcaaaattccttttaccaagtaaggtaacattcacaagtttggaggattagaacttggatattgttggcgtgggcataatatgacctgctctaccagagttcagcaatctatagcctgggggtcagccacatgtttatgtaaatagagttttattagagcacaccaatgttaattctttacatattttctgtggttgctttcctgctacagcagcagagttgagttacaatagagctcatatggcctgcaaagcctaaaatatttactatctcatcctttatagataaagattgctgaccttgtaactagatttactgtcaccttggacaaattagtctcactaagcataatagaatcataactttatagactgggaaagaaccttaaaagtaattttggttaaactctaccctatacatttctctgcgtaaatcaccttttcagaaaaactggtgaatggccattcagcttctgctccaaaacatggaactaaaaggagctcactgtctcatgaagtagctcatgtttatttcaaacagctgtaattcttcaacaaatagaaatatattatttatattgaccaaaaagttgcagtcttttgactttcttgcctagtcttatttatgccttctgagaccatagagaataagtgaaatctctcttctatctgtgagcactttaaaaatttgattctgctatcatatctgaaagttatttagttatttgcataaatatgtggagtgtcaacaaaggagaaagagacagtgttctcagatcagaaccttgctgagcaagctgcctggacttagctgtcactattgcatggatgcaagggagtcactgcccctggtccagcttttatgagtttctctatttgtgcctgggaaattcaccaaagagggtggggttgcacactgttaacgtctccctttcagatgaggcactcgtatttccttgttcaataagccatgtaaatatggctttcagttcacacagcgtggatgcccaagcctcaaatccctctcctataattctgattccatctccaagagaattcagatgctgttagtagtctgtaactaaagcgaaactaagaagctcaatgaaaccacagctcctctgttaatcggggaaaaccaaactcctctagagggcactgtagcactcaccgaattctgtgaactgagaacactggtttaagagaatctgaacagataccagctcttaaagaaaactgtccattccctgggagtgaggttagccagggggacagagttaagccaataaaaaggggctcaaaagagctaacttgttactagagctacaaaccatgtttggattaatctccggtgtcctatcctaagtctaaagcttccctggtgctttattcactattaattcctgtatccgacaatatttactgaatccttactgtgtgctagcctttgtgttagggactgatggaaaaaactaagacaaaaacaaacaaaaaaactctgccgaatttctccaatttgccttgaagtctcattctcttttgtttattaataatccttatctaaaatcccttagcaattggagatctctttctccttcgttctttatgttgaatgatgtcttcatcatccccattagcaagttagaagaccgggagtaactttatacctatcctcccttctcttttcaattcggcctcccattctaccaattttacttaacatttctcaggtctatcctactcatttccattgctccttgccactgccccaaggtagcattatcttacttctgctcacctttccaggtttatctatcaccatttctcattatgaatttacatccaggagtactgaggtgcttgcaatttcataccctcttctgctttttcttttttttctctatttttgcccctccccgacttccctggcttatttctactcatcttttaacgttcagcccaagcatctcctccaagacttctacttaaaattacccttcccatcccttcttctgctaccagactagttaagttgccccttttctggacctttagagtctggatacatctttattaatgctgtttccgttttttcttgcatacgagattgtgagctccttgaggaccggggcaattctataagattcatctctacatccttgatgtttattccagtcctggaacatagctggccctcaatgaatgttatttatgtcaatcaatatttaaatcaatttgatagtacccatgagctgaggccccatagagaggaggggtgtacaaagagaaatgtcaataaattgacctatatatcttgggatatatctctgggcctcctacagcagttctccctcagatgatgaattttctgacaatgatgtgcattactgaaacatattcctttcattaatagttaggtttcaacagtaataattaggataaccatttctctcactgtttccacaactggaagaaattcctaagaaaggaaggtatatgaaatttgtgatgtaggagacagaggccaacttctttcccattgtaaccagcaaatactgagttatgtaagggtccaaagagaactatcatagcaaagtgctggcagagattagtgatgctttactcctgttttgtttaccataatgaactggtcaataaacatcacaaattgtttatctatataaatcttgacagattactctttatgaaatccatttagcaagcgaggttttcccataaggatgaaaaatgaagattttaaacagattgcgggagaagctctggctgtaccaagagagtcagtgtaataaaggtttctttatattaatattacaaaaaccatttatcctggcaaaatcaatattgcaattcatcttagtttggtgtttctctttctaagcttaaaatgtcttttcctttattatgtataattttgttttaataaatgtgaaatatatttcatttaggaggtactcttgaggagggataacttataaaatgacatcaaatttgtagcttatttgctaaagagtcttggaagtgtttaaaattatatttgagtggctgagaaatctaaaggaatcattttgcttaatccttaattacaaaattatccctgtgtcctttggggtaaaaacaaactacaattttcagaaaagtcttcgcttgtgaacttcatttaggaaaaattctctcttactgaagtcaagtgattataacaagtcagataagttgactataacaatggcttggataagagactataaaatcaagaatagacacatttaattgctcaaaacattgcgtgctttggctggaagaaaatagaactacatcaaggaacggaattatgttatacattggaagctattactctaaatgtactgtatgtaaaataagtgtgattgtctcatgagtgaatggtaataaaaactgaaatactcaagagacacttattcatgagtggtgcagttacacatacatatatacacacacacacacacacacatacattgagagaagcttttctcttattgtttatgctcactaatattatattaaaagcctataaacaatagactctacataatagcctataaagaaattaagagcaaatcaagtatttttgcatctataattccattttaattataatacataattttcttcagctctaaaacttaacctaaacaaaacatctatttgaaatggaattctgatgtaatgtgtatagataaaagacctaatatagttgtttgaagggggaaaatgtccttttatcatgaccataaaaacggcaaactacagtacagtggttttcaagaaaaactgtactttatttattcccaaggggatattagtccataaaacaaatttgcagcttatttggcagtcttagcttttatcagcctttttaagggtgttgaatgattacccaagagatcacactgtaaaaatggcagtggggaaaagtaactccatccgttcagcatctttattagaatatataggtgaatccatttgatgttgttttaaacgtaccacaaggagagtaccttttaaatggtgagtggtcttcttacatgtgctgttttgcttctctaatacctcatggcaccaacgttgcttatcctaattagtgccattggcataggctacatgtttgaataattcactgtgaagaaacaagttttagtttctatcatggcaaaatgccactactggtatttttacaagcaactttgggtccaagaaatttaagttgcactaaagttatcttactatatttatgtcattagcatcttttcataaatcagaataatgctgtattctccaaccattatggataactaagtttagttcataaaacagaaaatgaaatataacccatattaaggcatcaaaaatatttgaacctgtctttctcaagcaattttcttagtgaaatttagtcttcatcgaactaactatagaattttaagatttttagggagagcaatgatttacccctgattttctatttcgcaattggagagtcacttgaaaagataattttatgggtacctaatctaaatgtttagctgacaggaacactgcttttgtaaaagcaaaatttacagcattcttaattgaacaactggattcaaactaatccataagatatattgtgggatgtaaaaaagcaatataatatctttttttgctattaattagtttataaagagaaagctttatacgggttttaccaggaacagtagttttataaagatcttttctattttcctttattttatgttgattctttgtttgtttagctcaagcattcttttcaatatattggctaaaacaagccgtcttactctacaatgctattggtaggtgtaacttatactatgaattattaatcaaaacactattctctttgatggtttatttgccttgttttcagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaagtaagtgaactctggttcagtgctggtgtgtgaagcagcatcatacaggggactgcatctcattgttttctttctccatttagaacccatcagaaaggcttagtacaatgtgaagaacgtaggtaagagatggaaaaaaatacactgaatgaaatatgtctgcttttccttgattagacaattggaaatggtaatataattatgttcatggtgggaaatttacaatagttttttggagtgaaatcaacaatgaggtgattaaagtcctaggttttcccagaccaagggtcttcccaggacacaagacttttaatggtaaaatcaggactatattggttaaaccaaaacagttggtcaccgacacaaagacatttccaggtaagttatttttttttgacaaataaagggtgaattcttgtttattatatgtttgatattcttccatcccccaaattttgtgggcagtattataccattagttgtttatcgatattgtaataattagtatcattcgtcacgcatattattcatcccataattcatgtttctttctactttaagtttcactcatttaaatatctctcacatttatatttttaattccttaaagcctaagattacatgtaagtatcttttgacttttcaacatcgcttttcagtaccttgaattgacctcacaaggtcacctgcagttctacaatttcataacatattgaccgttttcctatatttacttcaagatcatacatccttaccctttccagaatccctaagaaatgcctgctgggaacatgtggtaggagccctctacaacatattgtgctatgcatattctccttggggtgtcctgagactgtcatgagtcacaatgataggaaacgccacaagtcatgacagatcatcacaaaccagcatgcctggaactctgctatctacatttaaggggggagggagaaagataagtaatgggatattggactccacaacaactgtactagattttgaggtaatggaaagcaggatatagctagtgattaagaagacgtattcatattttgtacctgtgtagtttctcttcagcatcccgcatttcatcagtccctctggatttcagtataagtaaaactgtaggtatttatgcttcttttgggaaagaactgtcataattcctttcatgtataaatacagtctaaacataaatctggacttcattggccacttaattactatgtgtcatttattgattagcaatacaattgattgctttgtatgcaacaaaaattctagcatattccttttggatatgagttatggatcgtcatttataatggaattacaatacctaatcttagtgatttctgattggttctgccactaattttgtgacaatattggcacctgctctactttttgctacctattccttcttgcatttgagacatagtctgggaattatctctcaggcaaaactggatagtcatgtcactggaaagctagcctacaactcttagtagtggtagacatttaattttatgttttattaactggacattctttccaagtgtttctgatttgttagaatttttaaaaactctcacattcctaatgattcttccctggacatattccttttggttttttatctctttaaaattatgatatatcatactgagcacagttcttcaactcttgtggttgttgctgcttctgttttaggtttttatttaacaaaatttttgaaacactgtgtaaagttggaagctcagcatcagcagaggcaatttattagaaacaaatgagacaactttcctgccttcagaggaggtcaaaacatagctagagtgatggacactgataataggaggggagcagaaaaatgtaaatggtgggatgaggatgaagggtcccagccttctctcctgttccagcttgattttcacatggtacttgtgtttgatcctagcagaagccagccagaacaattggcttcacaaagatatgatgaaattgaaaggaatgtagtgctatctattgctgacacagtgaactacctctgactagtatttgtctctgtatccaacagatgtcaagaaatattttcatttaaaattaaaatttctcatggtaccccaccccctacacagtttgggaactgcaggattataaccctcattatatcttctaggggccactagcaataatttagtaatatcatctgtgatttttatttttggtgggctgtcagggtgggaatcctaggatgtaatttccaaaatgcaagaggattgaatgaaaataaagtagttagaccttttcttatagtaaatttcccttttgggtgattcacttctttcctttaaatattggtatcatgctttcaaaatgatagtcattcttcttgataggaagcaaaacaagaattaacataaattaaatagtcctattttctgtatgctttcctagcgaatgatattctagttagttcaaccatctatgaacctaactaaaattatacacatacacacacacacgtatacaattagccacttattgtttgatagtgtttgtcttcttgacactattctcattgttatttattcatctttatatccacattttttctttatctctccttgccagagagcctcttctagctctccttttattaacagctttattaaagtataatttacatattatatatttaacaattttaagtatatggtttgatggattttagtaaatttagacttgtgcaatcattactataatccaattgtagaacacttctgtcatttcaaaaagttcctttgtgcccatttccagtcaatcatgactcccacctctagccccaaacaactagttatagggtctttgatgagataattttgcctttcccatgagttttatataaatgaaattatacaacatttagactttttgcaatgtataggcttttgtatctagcttcatcttaacaaaatgtttttgaggttcagtcatattgttgcatgtctcagtagattcttttaattgctgagtagtattttatggatacactatattttgtttatccattgatcagttgacatttagattgttttcagcattggtctactatgaataatgcatccatgaacatacagttacaagtctctgtgtggacatgcatctttatatctctttatatcctgagaataaaaaggctggtttgtataccaaatatatttttaatgttttaggaaactgccaaattattttccaacatggctgtattattttacatttacattagcaacttataagagatccagttactctatggtctcagcaacatttggcattgactctatttcattatagccattcagtgagtgtgtagtagtatcttgttgtgattttagtttgcatttttcctgctgactaatgttgaacaacttttcatgtgtattgtcattcatgtgatttttggcaaagtatctttgaaatattttgcccgtgttttagttgttagtcctcttactgagttaaagaattccttattaatttgggataaaacttgcaaatagtcctctcattctgtggatttgtttttcattttttttattggtatactttaaaaagcaaaagcttttacttttcatgaagtcaatttaccaagcttttcctttatgggtcatgtttttgtgtcctatctaagaaattttggattgactcaatgtgaaaaaaaaaaattctccatttttatcttacagttttatacttaaacatttacatttagatccatgaaataatttgaattagttttgtacatggtatgagttaagcatctaagttctttatttcatttttattttttgacacataggtatccaaatgttccattaacatttgttgaaattgccatcctttccccattgaattacccaagcatctatgcaaaaatgcagttgaccccatagctaacatcatattcaataatgaaagactgagatctaagatcagacataatacagaaatgcccacatattagccagagcaggtaatcaagaaaaagtaagtaaaagtctcccaaattagaaagttgattttctttacttgtagatgatatgattctatatgtggaaaatccaaacaaattcacaagaaagctactagagctagtaaacaaattcagcaatgttctatgttacaagatcaacacacaaaattagttgtgtttctataagccagcaatgaataatttgaaaaagaaattaataaagcaatttcacttataatgcatcaaaaatttaaccaaggagatgaagacttgtacattatctgttttctgtgtttccaggaaacctatagtataattgcgcaatgttatttctatgcactgttccttttatgcttagccatgtgctctccagtgtctcatgagtttcatgcaggatctgtgtgtgatcacttttctattaggatgctaagatagaagtaattttcccattagtatatattatctgtggtaataaatatattacttattgccaaataagccatttataattcttgggatgtaagaatcaaggatgccttccagcacactggagggtagaggaaataaaggtgatatttattgaacaattactttatacacatatacacacacacacacccctacatacatatgtgcatgcacacacacacacacacacacaaacacacacacaccttatcttcaaaataaccctgacggggagacattatcattctcttaatataaatgagaaaaggttcagagagtccaatcaatatttgactataatcatacaactaccaaagttccaaagctggagattcaagctggtggttcccaaagagatggatctagtcacaatattatactctcatcccataaaagagagtctggcatatgcaaagaccattcttggcaattttgatgagtgaatatgtgaacattttttaggaattctacttcaagcacataaaggttcaagttctctcatgctcaagatttaataatattattctcaaaagtgttggtaagtcatctaaaccttctggcttatgaaaatttcaacttaaataccaaagaggtactatttatttatgctgtggagtcagacaagattgtggttgacatggtcatagcaagtaatcagcttaaatgtttggaaagagcctctgtgtgtgaagaacttttgttgccaaggatattttcatgtaatgcaaatcattttctacaccctttgacatgggagtgaaacatctatctctctttcattttcattcatccccaaagcattttgctgccttagaaaatcatctgaaggtcagttttgattgctctaactctgaaatctgttgtgttcctgatagcatgcagagttttagatgaaatcactaatattcactaaaaaatgttaaattaccatgaattgcaaggttctttgagagtgctgtaaatgaggcagttgatgatatttgtggctccaccaagaacaacaggatttaaaaccctaaattaaaatccactgaaagggtcaaatgcattttcagtgttcaaccgatcaaagtgaccatatcaaatatggaaaattcatgaattcaaaaatgtaaggtgttattcggaaataattcttttctcatgtgtcattatgagattgttgctactcttttcctatgtctaaataggcatatagactgttggaatgttaatagaacaatgcaaattccaaagaagaaaaagacaaaaggagggcaatgagcatgtatctagtttgaatattttaaaacatatgatgtaaatattatctgccttaggatcagactttgtctttaggaagcctattcatagtacatggaattttatatattttacattcagtgctgtgcagaataaaacaacattttccccctctgttctcacaccaccatcaacatagttgaacaagcaattctgcagcattaatatcctacaatccagttcaactcttgcgctatatacctggaagtagtggcagattccacgggtgaggggtcagtccccaaggctgcccccaacttctaacaccaatcacaagctccaggttattttgcctgtgcttgtaacccactggctataaattggggctcctatgactccctccttgggttcaattactttggcagctcagctcaaaataaggaagcacttatttttactgatttatgatacaggatattgcaaagatacagatgaagcaatgcataggacaagatacgtggaaaggggagctgagcttccatgtcctccctaggtgtcacaccctccaggaacttccacgtgttaaactacatggagctctccctgtacccccaccaccccccaccaccccaaacaccctttttgttgttgttgttttagacagagtctcgctctgtcgccaggctggaatgcagtggcgatcttggctcactgcaacttccgactcccgggttcaaacgattcttccgcctgagcctgccgagtagctgggattacaggtgtgtgccaccatgcccagctaatttttgtatttttagtagagacggggtttcaccatgttggccaggatggtcttgatctcctgacctcgtgatccgcccgcctcgaccctttatagcaacttcattggataggcatgactgaagcatggatgtggcagactaccacaattactacttgagaccatcactacaacagttactactgttactatttgagactgtcattacaagactgaatgaaggaggatgaacgcagaaatgaaaacttaaaacaaaaataactattttacaggaagggtaacatggggaagaagaagaggggtccctgcttcttgtgagcaagggcagctgcctgagctgcttcagcccttcatatttattgggtagaaagagcagggaggaggagggcatgattggtcagctgcttgattgatcacagggtcatattattactaacaggcttcagatttgcctaataacaagaaacacttgtgcctgggtcatgactgccctcagcattccttccgggtgcagacgcagtttgtcagcttgccaacatcctgctttcatgagaacagtttgctgtttactcatatagcctccagtggtatacttagttgatcacgaccctcattcttttggccttcaacacatggacaactatgtagaaatgtgatttaaaaaaaaaaaggagtatgatttcatactaatcgactgagtggggaaaccctgcaaggctgcctattcagagtcttcttggcctctctctgcagtattcattcctccagggcatggggcaggactccttctaaaatgagggtctcatgacccacagtcagacaaggtaggtcagagaatttccttatggccggctctaagacagaaaggtggaggaacattagagtatatttttagtttccctggcctgccttggggagaaaaaggaacaggtagaagcagaacagaacagagacagaccctattttctgaggcctacttctgaagcctaaatctccccaatattgtaacaaaagactgtccttcacctgtatcactcttaaattgttctgaagctgcttcaggacccttggataaaagaccaatacttcaacaaaagataggcttattgtgttagtcaccaaggaaatagcaaaggctatggaagttatgagccaggaaccatggacaaaaacgtgtgtgtgtgtgtatggtgtataaatatcaaagtgctcttgaaatcctgtcttaaaatgtaataatttgattatattatatcttttagacagagttcatatattatatctattaaaaagagttcatcactcatgggtcctggtgaattagcaatagctctggggtggaagtctttgcttagtttgcagaataacttcactttactgttccctacttttccactttgctctgtcctccaagattctatgtggtttgcatcagcagcctccattgccctctggccatcagttagttgatttcagctgctaagagggacccaccaaacatctggagggcaggtggaaaaggaagtcaggatatttaattccccgctccctgtgtccatgtagaagcagcctcaagctaactgcatccctccatgagtggtcatagctcctgtcaggtgatgctcttcatacagtcatttctgtccctgagttctgtccccatttaagctagagatagtgtgcagagaagagttaacatagcaagcctgactgcttatttttagaaagacctgcttacaaagttggcctttggctgacatctggatccccactatccccagaactgataagagaggaccactgcacttaaacatttgtacaaagtacggtttatgcttaacacctgctttccttgtgggggtcttaaatttgggtaaatgccagatagaggctgctcataggaacagcccccaataaaaaccctgtgcactgagtttctaaggagcttccctgattggcaacacatcacacatattttcataatgcattgctgggggaattaggcccattctatctctactggaagagaattcttggaagcttgtgcttggtttcccctggacttcattgatatgccttttccctttgttgatgaattctgtaacatttcactgtaataaattttagccatgagtaggactatatgatgagtcctgagtcttcctagtgaatcattagacccagggttcagggttggcttgagaaaccctgacataaatagcaaaagagctctgcagttctgtacctgagagtactggaccatctcttttgcccacccttttgaaagtggttcctttattgagctctccccaagttactttttttgagtgtgctttcttttactgaggcttctagtgactgtagatatttcatataaaaatattaattatttgatggattcttttctgtaccttacatttacatatttcttaacaaaaagatgaatggtttaaaagtaaggtaacacagcaacctgtacccttgacatcttatttaaggagaatgtttgattaggttgtgcttctttaaatggatgggggattgtgcatcttgtttaaactagaaaatagtacgtaaactggtggttgattgtccctaaaaatatttagctgttgtttttctcctttatctttgcgtattctggtgaaaaaaaagaaaattcactctcaaaagcagggagactaagaaaaatttacagtgacagaacacaatgttttcatggtatatatttatattatagaaaacatcacttaagtagtgagatgaatgttcttatttcttatgtgcctgataagcaattgtattacatcttaaaaacacctctaacaggtgatggtacattcatatagtatattcaaatcgtttcttgataatatttagattatttaacatccatagctatttatatcaccaaatattattctttcttttacactgtgctctctgaagcaagataaagcattgtgcttaatggaatggaaagcttcctctcaaaaacccaaagattatgctacttaaatttcaagtttcaatggaacttatgtcaacttttaaattaactatgtaaaaaataaatgttgtgcatccttggatggtttctcaaaaaaaaaaaaaaaaaaggcaaagaaagaaatgcttaatgtaaactatggtggttttttacccccaactatatttatgccagctgctttgacctaaaaagtttttttatgcttatagataaaaagctttgttttagagaactcatgaaccctttgtttattaatgtcttggtaaaccacatgtcttcttgataaagcaatcctgaatcagaaagacctctttgctggatatcttacttcagtttgcttttctgtttattgattgctttgctaataaatgctctcttcattgtaatttagctccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtgagtttaagggtttggtaatagaaataaatattctgagaattgacacattagttaagttctttgacattgaggataaatgctgttgtggtttcctctgtctggcacagagtgtttcaaacagagataaaattacaaatttcactagtaatcaaagaaatacaataaaaatgagatgcttattatctgataaatactaatgcttatcacattctcaaagatgaaaaaaaaatgaccccatcaagaattgatgggaatgtggggaagctggaacttttataaactgctgaggtgtctgtgtgagttcattagtacaacttttcatgtacaataatttgttaaaatctatgaaaaaatctttccttttaacataacatttgacttagcaaacttattttaggaagtttatctcaagtgaacagtcattaagtagacacacaagatgtccatacctattctatttgtaacatcaaaatattgaaaatgattcagatgttcaacaatgtttcaggaaattatagtatatggcataacagaatcctggtacattgttaaataaattataggctatgatagcatataaactgataccttagttcacatatcaataaatggaaaatgttcatgacatattgtttaaggcaggggtccccaatccccaggctgtggacaggtactggtctgtgacctgttaggaacaggaccacacagcaggaggtgagcagcaggccggcgacattactgcctgagccctgcctcctgtcagttctgtggcggcatgagattctcataggaacaggaatcctattgcgaactgtgcatgcgagggatctaggttgcacgctccttatgataatctaataataaatataatgcgcttgaatcatgccaaaaccatccctcctcaccttcccatcctgggtccatggaaaaactgttttccatgaaaccagtccctggggccaaaaaagttggggaccactggtttaaagtaaataaagttattaaaataatctgagaattataccattttaatttacaaatactggaagacataataaatagatctagttttctctaattgtaaatattatagaaaatgtatcaaatatttctattataatgaattcaagttttttaattctcaggttaaagaactattaaatctggcagtggagtactaacactcaagcaaatagtgtaatttaatacacacattgctgtttccgcagagatagaacacagcaacataaacttttgaaagagaaaggatataaacaagccatcaagcctatctttgcctttgtaacttttatgaagattttaaaggagcttatagaaatcaaattattagaattcattgactttaaaaaacatttactcagatgttttagatacagtttccctaaagacagaatgaaaaaaataggaatttttacattattccagctctatcttctctgatttttgcttctagccatgtttagctacacactagtttaagaaacctcggaacagcaattccaattcaagtttctattttgttctcttcatttaatacacagttttccaaattctactttaaccatgcttaattagttggagaactgtttaaagctctgtcgaaacactgaaattccataaccttccttaaaatggttaggaggatgccttgttttaacattttaattgactttaaaactcctgcatcgcatagagttttattttgtatgcattatactgggtttcattttgcacctaattcatataactggaatttagtttcttatgtccacccctttctcttggctctacatgtctcttcagtattccaagtcttctttaaagttaatggaaactctgaacttcatgatgcagattgcaaagggaaatgaacatctgtctacatctgccatgttggcaaagtatcctgaaaacctgctactagaatgtttattttcttccaaatatcagcatgatccaggtgtcctgaaacttaaacttttgtgacagagaaagagaggagttataaaaatattgaaaatgattttgaagatgacagtaccactgattatttctgaagttgtgaattagggtcaccctactttccatacagcttaatgcaatagcaaaattaaacttaaaactatcaatgatattattcaagccagaggcatgatttccatagtaacatattgtgatctattttatagaacatcacatgttagtacaacattggctgtttttgacgattgcactaataaggaatccaaataacattttcttacataataaatgtgtattcattcactaatcagacatttatataatcctattaaacaaggtatcatttcctaaaaccatatttttcattaaaaaatgccacttctggcatttcttgacaatcactgtaattaatgatgtgaaaattatctgcatgatggcatttgaacagtaagaacaattggttaacactgtcagaactttgtatcattctaacaatagcctcatgtttattactctatttctagtgcgtggctagcatgtgtaacatgtaaaggaaacactacttatattcagctggatgaacacaaatctttgggttaaataaaggcattaggaattataggtggagaatcattgaacttttcaaagaaaattaatagtgttgtcttccaagcaagtttgatagtttgtttgagacctttatagaattcttttttagaatggaaactttttctagctggcctaatgtactatgggattctctaagacatattttccttcttaggatcatgatatactggtgtaccatctttaaagctttcaaattatttgttattataatagcatgcaaataatgaataattttaaagattgtgaataattaactttaaaaaacaaggtatatctttacgttttatttaaggtagaggtcaagctagcgcttcgagaatcatacataatcagccctaacagtatctctattgtagcccccttctgggttgctcataggtatcttacgtgtcataggaaggaagtgaacagttattggaggaaatagcactcttctgttagtgttgcaggtttagggagtggacagtaactcatactgttttttggtgttgttcctatttgagtttggaatcaaaggagcactagacatagtaggcagatcaaatttaaaaataaaaacgatcttcattactgatgaaagtcagattagagactatatcctttttcctgcaggaagacaaattagaagagagaaaaatcaatgggctgatctgcacataatttgctccctacaccctgactccccagattcacagtcagatgagttgttcctcatttgggatggcatgaatggggagatagcccttaaatgtcactttagagaaatccttccacaggaactagaggatgattatttttacatgtaacaatgacttctatcacctacagatattatcgtagtttaagcttagaattttagacaaccaaatattttaatgagccctgggatttcatttctacccttattcatttccatctttaaaattataatttataatctcatactacatcaagggatcaatgtaacaagtggtaagatgattcagttagctctgagaggaataaatgaagaaatataagatatagagacaggatgagaaaacagaagagaagatgacaggcaactgtttttataaggctcttaatattcttaatgcggtagtttccccttatccatggttttgttttctgcagtttgttactcatggtcaacaatgttccaaaaataggtgagtctacagtacaataagatgttttgagagagagagaaagaccatattcacataactattattggggtatattgttataattgttctattttattttcagttattgttgttaatctcttactctgcctaacataaattaaactttatcatagatatgtatgtataggaaaaagaacagtatatatacacacatatatatgtatgtatatatatgtgtatatgtgtatatatatacatatatgtatgtgtgtgtatatatatatagtttaatactatttgttgttttaggaatccactggagatcttggaatgtatctcctgtggataagaggggactactatattctttcctggaacaatagatcaaatatgtatagaaaaatcattcatgtgtttaataaaattttgttcagtgcttattccagaccagaaactgtatcagtcattagaaatacaaagatgaaaggaatagttctccttactgagtggggagacatataagtaaaccaaagtaacaatagaatatataaatgttgaagcagagtaaacttggggtgttaaggaagcacacggtggcttgggaggtgtaggaaatgtaaccatgcctgtggtggcaatgatgtgatggagaaccactgaaagtttcccagtaaagaaagaatataagctgaattagccagatactgtagttgaggaagcgtgatggtcatgaaataaattttgtattaaaagaaaataaggtatattcagcaatcatgggcagttccatgtagctttggtaagtggtacaatgggggagtgctacaaaccaggagggtatcagccaagatcacaaatcagtgctgagccaaggactgtaaatgtttctctgaaaatgcagaagtctgtagtaacagcaaattttcaaattcagtgttaaagatccgtaccccaaccaaggagagcaactaccttgagataagcactcttttaacctgagtattatttttttgttatggatcattaatggatatcctattcataccctttcaaatgcttttatatctttcacactataaattgccttatatgatattcctacacaaatgcatatttccatcccaattctatctgattctaatttcttattaagtagactgctcttgtataatacattctgatctattaggattatattccacttttcagatgctacaaacattcagcaagtactgtacttcttttaattgtcatcaggttataagtcttccaacttccagtttaagcttatgccagacaatcttttggaatattcagcactgaaatttatttttttcttttaggttttggcttttggcatgctaaattattttccatcgttgttctagccttcagtgatttttcaaattttgttaatgttttcaacaaccttattgtgggataagggtaactttaatctaatctagtaaatatttattgaaataacaatgagccacagctgcacgctctctagaaagtctgaatctcagccctaggggacttttccaaatatgatccttctttgggtgctctgccttagcactaaggatggtgactttcccctgtctcttctattcctatattctttagagttttctgtaccacttagaaagtaaaaccaggcgacctctggtacccatggtacaactgaaaacagccaccagagagagaactgtctcaccttcctcggctctatcagggtcatctctgataagacagtggccctcacctgagtcagtgcccaaggtgccccccacaacaccagcggaggcctcctccactgagcagtcggaccccagagtgctctgtaggagctgtagactgggaagaagggccgggtgtggtggctcatggctgtcatcccaacactttgggaagctgaggtgggcggattgcttgagcccaggggttcaagaccaacctaggcaaaatggtgcaaccctatctctacaaaaaatacaaaaattagccgggcgtggtggtgggcacctgtagtcccagctattctatttgggagactgaggcaggagaatcgcttgaacccgggaggcagaagttgcagtgagccgagattgtgccactgcactccagcctgggtgacaaagtcagaccctgtcttcaaaaaaaaaaaaaaaagaaaaaagactgggaatgcctaggtttacacgatgggttatcactccaaagatttgtgtcttttgtggccaatggcagatccaggaaagaaatgaaagttgccgatggggataggctgggggagagcaatacagatgtgtatgggaaaccccaacccatatatattgtaaatagatggactaggctaaacattgttgctgtttcagtcttctgcaaactcagcttttccacaataaagctctatctcctgtcggaaggaaggaaggaaggaaggaaggaaggaaggaaggaaggaagggagggagggagggagggagggagggagggagggatggatggggggaggggaaggggaaggggaagcacataaatatgctgggaccttcatattgctatagggcacccctgcttaatggaaccctcctcgcatctccaatgcaaacagccccatggcggagcaggcagcagccactctggtatttgtgtgtttcgcagtcctacagtgtgtttcctgtccttagagaacaaggatttccagccatgtgcctaatcacctccactccctatcttattttttaaaaacctctttgtagctgcttctctttgccctcacaatccttcatgcatagaagtcctgcttatctaaaacttctgttgtgtaaattcctcattgctgataacaaatgtctccaaaatttagcagcttaaaacaataaacatttataatttctgtaggtcagaaaataagaaaattttccattcaagatgttggccaggtgacagatttaccccttggtggtagtttactgacccttagtctggtgtgtttagtgtttaacaagcaaacaagttacatagaggaaacatagttacttttctgttttggagaaccgcaaggactttctcttagaccttctaacaaaaggacactatgaaaagcaaaagaagaactaaaacaaacatctaaacattctttattatgaatgatactttcttatactcaataataaaagcaatcaaccggtatttacattatttcaattttaaaaatatgaaatgtatccttaatcaaaagagtagattggtatagtttatgtaattaaataatatgataggaaagcagttagcaatgattcttcaccaacttgtgaaatgtaactttgttttttttttttcttttcatttcaggtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggtaagaatccaaggctgagattcccctttttggtcaagacatgaatgagaatctattgtaattgtgcaattaggaatttggcagttgtattcctttttataactgcacaatataataattgagaaacagtttctaaagatataagatagtatttgtcctggttagtggaacaagtgtatttcttctaatctaataacaaattccattcaattaaattgccccttaaaaggctaatattatctttgctcttaatgacatctgccataacacaaatgatgtttataatttgaaactcacttatgaaatgcattatatttgactgtgtcacaagttagggcacccacaagcagtacatttttctcttctaagcaagaaaaagatataaaatgatacaaaaaatatgtatataagctaactgactccattaagttaatttttgcattcatgcatttgaacccttggttatataggccagacacacattcacagatttttaatcatttatatcatgtacatattatagcaaaatctttctttagatttgtaaagttatttggtaaaactgggtagagattgactataacatttatgcaaacagggcttatgttaaacaagttaaattaaaacctccaaatttgaaaggatacagactggagctataatgatcaaattccccaaaagaactggccattcttaacagaaattgtgaatatcaattctgaaaaagattgaatttacctatgataaagtgtagttattttttgtctatgtgttatccattttggtttgttttcctcatgagtatgcctttaatagtattttatacattcatctatatagcagtttgttgtcttctatgtacctgtcatctagattactaaactactaaatcactacattttgaatgctaaagaaattgacagtaatctaattagaaagacaatgaatatccagcactctttaactgacctgtccctaccctacccctaaagtaacccctttgtctgatgagttacgtaggttcactatttaatttctctaggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcaggtaaagatcaatgttttaaattctacttttaaaacctctgaatgcaaatgtttcctcaaattaaagtcaaagtactgtgaaagtacattttgaaaagcaagaattagaaacttccatagaccaaggaaaattttcatatatatggatttgttacataaacaactcaaggtcataaagtacttgcagcaagttctagggggcaaaagtaaatgctttagttattaattcatggggcgaaaatggcttaactatagttatagtcttctgggaatgtttgtcaaaaatagcatttggtttccactcctgaagtggattggacacatgtctcatcttgctccatatacagcctaatttatgttcaatgaaagagataactgtcaccaattccacaaatttgtctttgtttttatttatctttccaaaataaatagtttagatactagattgtacataatgacagaatcgtggacatcaaaatctataattcacaagtgtgcttgtaagcagttggcatgatgataaggaaggaggacaacatatctaaattttctggattatcttcattaaggcaaaaatttttaatcctccactttattttttatattaaaacacttcaaatttcatgagcctttaagaaaaaaaatacacttttgttatgtgtttaatctgtagatatcaaagaaacccaaaccctgatctaaacttgacctgttaggaatatggaggatgagggtagctttaggttgatgtccaagggaatcatttcatgaataaaatacgcattgtgcttgagcatctcttaatgactaccagccatcttggacaaataatagagccatgatagcacaagtgatgaggcatggcattctggaaggggaaaatcaaggtcagaaatgaaaagtaatgggtgaaactgcaatactggtccctcgtaatcttatgggtcactagctaatgaaagtgcaatgagttcctttgataatacacctttggttagcacatttaaaatccctgtaaagagctcaggagtggcaggggggaaagggaaatgcatgtgtatgtaacctgaacatttcaagaaaaatttaacaaaaactttgagacattcattggggttatttagaatgctttaggtttacctctttctgaagaataatattcagccagctgcattggattggctcaatgacatatttccctacatgggaaatccagtacatcaccatgcatttttctgaactttttgaactgagatgttctatttttgtgacgttttttagatactcgtaagacttataatttcctatctatccactttcctatctttatgaacatgagcaaattcctatgagatttttattttgcaagtagaaagtagctggtaatatgaagatggagaatatactttcagataacattttaaaaagtgaataccttttacatataccagcatattcttggactttttcaaagcagaatattttaaaaggtaaaggtatttcagaaactaaatgaatgtgtgaattaaatttaaaaatatatagggacgacattcattgttttgatgttattgttattgttctcattgatagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacaggtattgttatttttaactaatgtcctttcagaattggcttagggcttcatttggacattttttgagtttgcagaattctgtgacagaattctccctctatattgattaaacagggcattttttcttaatataatattatgtgtacaagcctccctctttgtatgtcacttgtatttttccagtataatcatatattgaaactaagttggtataatttatttcataagacttgttttttttccatttatcatgtatccttaaatattttacatgaagttgactttcattaactgtgtactatcatgttatttggacacacaataattatttaaccagtccacactcagttgatattgtattgtattaattcttttggaaatataaataacattgataaaacttcttatatgtacatttcatatacatttctacttcaaaaatctgaagaattgaatttatcacagcttataacaaaatgaattatgaatatgttcaaagttttgaatatacagtcatatattgccttctagtaattcatcccccagctagcagtagtgagaataattatcatagctaaaagttactgaggctttactgtgtacgtgaactaattcatctgatacatacagcaatcctagaggataggaggctcttgttctctccagtttacagttgtggctgatatacctctctgcccattttaccagcatccaggtggccaatagcagaagctgatggaaggatgtcaaccgaacaagttcttctgtgtatttggctgttcagtgcctcctctgagagagatgctcttctctgggcattagcataagataaaaagatctttacactttatacctactcccatagatctagccacatttttctttccatgaattcctagttcctgatccttccatctttttttttcatgcccttggccaatatttccaagccactgccatattgtccaggtacattttaccttgagacacgtctctttccacacaacatgggtgaccaggtgaactgcctgaagttctgcccactaagaggatttcttcgctctgctgtttcacagggtcatctctgacaagggttttagagcaacagctaccatttagacttgcagccacataccaagacatcctatctgtaaactaaattctgctttttttccacattctttcagctcttaagggacctcccatgggtcataggtatgagctgaggttgagccaccagtataagaatggtggatgtcatgggggcctgaaccacctgcttgcacaatgtattacggcttttggctctgcttatacccaatctcagacatccacttccattttatgatgaatttctgttgggcccttctaacctcaagacttggctgagacaattccaagattataaaaaagtagctctagctgcatggctatttggtgttccatgaccagatgttctgtttttactgaagcctgaaagcatgctagggccatttagcaaatggtatatagtttccattacatgttatgcctttgttccaagctcttggggtctatctgccctgtgattctctttctatgtgtgccttgcaacattttttcccacaatgcttacctctagtgctgtaaaaattactacatgttatgtcccaagtggctcatctgcctgtaccacaggctggacctggtgcagagccctttccgcctctgggatacactcaaaactggcagcattccatattactcagtaaatttctcagaacagtattctcaaatgtggaatatgctcccttcagaatgtgaagaggtcaactagacattttgtttccttcttagtggtggtagaagcaaggtgcaataatttgtcctttattttggaggggatatcctagcatgtctcaggccacttgaactcctaaaaacttcactgatatggtagattccttaatcttcataatattgctgtctcactttctagaacacatatgtcttacctctgcatacctaccatttcttgtttgtctgattcatttaatatgatgctatcgatataaagaatactgtcaaggtggcatttatagtttgtcttaaattggtgattaatcaccctcagatttcctttgtctttcttcagtgcattgatggcgaccagcaagatccatgcattgtccttataattactagtttccccagagtagtccttgtaattactaattccaccaaaccagtgaattaccttctactggtaactcatcgcagttcaccactaatggaagtttaagcattgcaccactagggcatgctgtggactgttagtactctacctgctgtctatgatgagatcattgtaaaccagcaagtggatgatggagctccaaaatatcattttagagtctccttcctagggccagtcctgttacgactatcttagggcaaattcccccggaagcagactcttggtagaggactgagtacaggaggtttattgggggaactctttcagaaacaacaaatgtgaagtgataaagtatgtaggattgagcagcaaagaagctgaactgtgatgcaatagtggaagcagcctcagcggattccgtgggtagttctggagctgaaatgaccctcttagcttatctcaaattaagctaggaagtcagacctttgtaccctagagtatttgtgtcctcgggctggtgtaacaaattaacataaactgagtgtcttaaaacaacggaaatttaggtgttagtacagccaggtcccccacaggctctaggagacaattcttctcttctacctacctgtggctcctggtgttccttggcttgtggcaacataactctaatatctgctgcctctgtcttcacaagtcctactctgtgtctctgtctcctctgggtctgtgtgtccgtctcatttctcccataaaaataccagtcattggattttaagctaacctgaaatccaggatgacaactaattaattacatctgcaaagaccttatttccaaacaaggtcttattctgaatttttgggagacactatacaatccactactaataggtttgccatttttttctaagcctttttaggagaccagaacccatgtacaacacacaattttattttctatactgatgaaaaagaagagccaataaataatttatgattacttatttttcattaatctgtctacgtgttcactcatttgcaattatctcatgatgaatacacaactggcataatatatatattttgacttaaacaggttagtctaccgatctggtataccatgggatttaaggtaaagttagttgtaactttcatgtggtctttgccatgttgtatctcatttatactcaatgttttattttgttgtttttactattctctggctttataaactattctttctttgtaaaacacagttttgatttatctattacttatattatagtagttgttgttctaagaaaaaaataaggtgagaaatattatttataaaatacagccttagaagtcaacctgtttgttcatattccacatctcccaattattagctgtatcacacgtctctctgcttctggttttattcatctgtgaaatgggaaaaccatttttgctcacctacctgcttaaagagcctgataaatattgacacattattattagtgattattattaatggtgtggaactacattatactttataaactagctatcatttaatggggcaggaaaataaatatttttattattgttgttgttatttaaaaggctgttccttatggctgaactggaataaggacatagatatatcaccttattctcttttttatttttatttctttgagacagagtctcgctctgtcacccaggcttgagtgcagtggcgcaatctcagttcactgcaatcttctcttcctgggttcaagcaattcttgtgcttcagccttccaagtagctgggactacaggtgtgtgccactacacctgactaattttttttttaatttttatttttagtagagacagggttttgccatctttgccaggttggtcttgaacccctagcctcaagtgatccacccgcctcggtctcccaaaatactgggattacaggcatgagccactgcactgggcctaccttattctcttttgaactctctctcctgtgcaaatattctctgttcaaggaaatgaaatcaaaagtagcagaacaaagtccaattttttaccttctcaatgattaaatttgtatctgaactgacctgagtatgtcttgttataatctttgtaaataaatagccaaaattcccagggaaaatctactataaaaataactagtaagaaacctttgcctaagaatgagacaggggggatacgtaaaagtggtgatgatgtaggattcattgtgggggatcaagctgctgtagaatttttcctacccctttgaagacttatttcatgaaaaactttcaattagatagattttataagacttataaattgactctatgtacatgataaagacaaagtctatccaagtgataattttatgctgcaagttctggggccaataatgtatttttaaaataatgtaatttataataatcatctgtaaagaaggaaaagccttttcaaaataaatattagtgtagatttcttctttcttattttatttcatcgtgggttcttgctacaaagaatattttgcttaaaaaatagttgtacttcctaaattaaataagaaatagcttcatgtactttatcctaaaaacaataccattttctaaaaatttacattgaaatctaccaggattattctaaaagggatgaatattacagcaatattcataagtttaactcagttcaaggtttattttacttagaaaattttaaatcacatttcacagaaaagtttgtatcttcattatatcaataatgattttaaaattagaaaaataaagaattacttggtatttgatgtttttcttatttcaaaatgtaattgcaaggaaatggttttaaagttttaaatttaaattattcctagagttttagaatctttaaaaacacctttatttctgaatgttattgaaacactgtattctacattccaatctcactgctttttagaacaactcatgtaacttacgaaattttaaagtcaacacctaggcaaatattccaaatgaattttattttacccctaaagagaaagtctctagaaaactactccaaatgttactgaactttacatttatctgtatttatatttatggaagattattttatatgactatgtatcagtagccctaagaaaattagttttgtactcatagttactgtcatactctctgttttaatgacttttattttctgaatataatttctagtggcctttgtacctacaacctaaacaaatttacatggttgcttttgatcacttcaaattataatgacagaaccaactctcaatgttaattgtttaataatttatttatggactgtgagtttcctgtcagtcttctttgctcaaatctgctattttcatttgaaattatatgataaagataatatttcaaataacgtaactgtttgatctaatctttatatgtttgtttatataagaaagatgattgagaattgacttaacgtggatgctcagtaatatgcttaatgtttaattttttcccctttttcttctgtgactttttttcataaagaaaatgatagtatcgatttaacatagcaacggcatttctttctgtcctagcaccatcaaatagcttgggtattactgctctgggttacttttggccaagccccatggctttgtttggactttatcatgataacaatgacaatgtcaccgtctttatctctaccattggtgacaataaccataccaccatgctgctttatgaggcaataacttggttttctcatttatccactcaggaactggattattacctcataaaacagtgtgattgtacaataatcaattaaatcctggcttgtcgagactcttcagaaaaaaaaaaaaaaacccttttcctaatggtggttggcaataattccctctgtctgaattcatggaactttgactgccaaggttatattttcacactgattacctattatctttctttctttctttctttcttttttgccttgaagctgttgcacactgctaaatcccaagaactatcttacactgtagaaggactgaaaccttataggatatatgagtttactattactctctgcaattcagttggttgtgtgaccagtgcttcgggagcaggacaaactttagcagcaggtaagcaagttttaatggatatgaaaaatctgttgcctatcaagaaaaaaaacttataatattcaacaccttctctacttgagactttatatttgtcttctcctccctcactaactctgattgcttcttacctcaacagttttaaacaacaacaaccaaaacgtaacttaaagaggtacctaggagctacgagttacagctgtgtcataataagaaatataattagtggtagagtgactccactctacaactagaaatatatagaatatacaactagaaacatatacaaatatatagaactagaaatacatagaaatgtaattagttgtagcgtgactccagggcttaactaccaacctgtgtcctagcagtgtcctgacaattgtgagaaacaatcaggaagcttcttatgaggacgttaggatacctcttccctcagtccagacattttttgtaggcttggctctactcactcctgatccatgggaacatctagaaattactgtgtggcctggtgttatatttggctttcatgaaataggtaaatgtttatctattgttttattaagaagaagcttttaagttaataaaatttaaataaaagaattgttattaagtataatctgagtagaaatggtttgtataatttgtgcttgcttcattcaggactaactggattcatacaaacctgattacatgtattagtaagacttataaaacccaattatttagcattaatatattttcaaatcagtgtttttctgattctagataaaagcttagtttcctggttatctttaaagaaatgtccatgtgtaaggaggttaagacactctagatgaattacagatattacgaaaattcatgtttacctgtaaaaacatttcctagacctcctccccaaatcccttcatcctattattaataggtccaattatgtagggttttttttctggttctggaaaaaattgcttagctcaaatgatctcatccaagtaatttatttttttcaaaattttcattaatgcaaacaactctgaaattctaagaaattatggtttactaaatttataactgaacactttgtatttttatgtattttatagatgtgcatttcagatgcatgaatacattgatggagtacctagcttgtacaaaacactcttctcctataaaactatctgtttttgtatactgtattattaaaggtttactgaatgctgaatatggacagcagaggaggactctatctcctttaaatgatacaatttcagactagaagacaaaaattaaaataagaatcagtcttacaagttggagaaagtaaaaatggagacaacggagggtgaagactgggtgtgttatagtaggggacatagggatcccaagcacgtggccatgcaaaactggaatcacatcctctcagggttgcaaaacatgtaaaaataatctagtgttactatatagccagtatcaatatattctttgtaatattcccccaagtgttcatctaacccatgtctgataccttcagtgttacagaaactactacgtctcagacaaagctataccatctttagatacctcttttagaatgtgatttcttagattggtcaaaaatatctcctagtaacttctactcaacattcttattctacttccttgggggctgtcgttaacctaatttatcatccttccaataacattttcaataacattatatccacccaagtcttttctcctttaggctgcatatcatggtggttcccatctgaacctcatatgcaatagtgtctagagctgttattagtataattcttgtagatgagatctagtctgccttttcatagatataagcaaactaaagaacctgaagagagacatgcccgtccctagaaactagctggatcatggagatgggaatagaagagcaggaaacatgtctacagaatagaatctgcctgccctatgcattagtggtaacatctgtgctaatagtatcctcattggttgcagtggcaaaatcctgttgcgtaaaagatgatgtacctgggtgctctgtgcagctctcattttagttactggtgaggcgattaaaacgactcctgtccactggcaggattgtgaagtaaaactaactagtcagagccctctgaatcctctctctattttttttatccttgaaaaatagaactggaaacttatattcgctaaaagtcatgtgacgtgaaagttagttgacttacaaaaataagagtttattcatatatgtgaggggaaaaaaatggttagccaaaatgccagggtttcaatccgggctctgccattgactagctgtgtgaccttatataaattatctaacctctgtgccttagttttccaatttataaataagcataacttatttgtagggttctgatgaggattagaattagttaatacatgtaaaatatttaaagcagtgcccatcacagttcattctcaataaaaatttattgtcatgatttttatcataatattatagaagacttttgttagtcacagtataaatgttatggaatttctaatgttatcaaaatcaaggagagtttattttacaactttgattttctaacattattataaaatataaaatggagagttctaaaactaaggattgtattgtgaaaataaaacttagaaaggcttaaaatctgaaagcattatttattatttctgtaagaagtatgtcattcagaattattatgcacatttcaaaactttgctcaaaaacagcaaatttcacatttgttggttgcaatatagagttaataatgtgccataaatgtattattactacattttattgtgaatgctcaattcagaaccatctcttgagggcttactatttaaagcactgtggaggattctaagataattatactcagcatttgggttaaggagttgagatccaacaggtaggattaacaccatggcgacatgtgctaagggctgtgagaaaggtgaaaaaaatgctatgggaaggtagaaaatgagataaatgattttgatttgggagactgagtagatacctcattaaatgctatttcagataaactataaaagaatggtaaagactttcgcagatatttactgagcacatacaatgtgctagtttctgttttaggggctggcactgttccaagtactgatgtaatgaaagcagagatttatgaagacttccctggtggtagagtacacaatagattagaagagggagtgtaataagtgtctggtagacttttttaaaaaggcaataagagagtaaatcagacgagtagaagtgaagattgaaagaagggaatggagtgacttcaaggaagacagacctggaagttaagcagtgggaaggatggacaatgatagcaaatattgcagcccatggtggtgccattaaataaaaggggaaagatgaacaaagaacagatgggagaaataaactcgtgagtttatttgatcatttgatagaaacacatccatgccaattataaccatccaggagcagaaattgcaaatctggggcttaaaaatgatgcagattttgtattcatctgcatatagatgggagctaatgctataggttataatcaattagtgaaagcagagaaaatgcaaaatggaagcccaaagaaaacaccttagtgaatattctatctgggaagaaagaagaaaggaagagtgaagtgaacagaggtatggtcagaattaggaaaagaactgagaggaagcagtatcagaaaagtcaagggaagagagaattctagaaggagaatattgtctgcagtgtcatatggtatagggaaagcaagagaaatgtgacctaaaatggatgcgaggtcactggtgactctctggggattaccctaattagcatggttgaagcagaagctggaacatgaaggattgagcagcggcaggaggagatatagtggtaaatttcaaatgtgtttttttttttttattctttgctaaaatttttcttctacccaattttcattcttcaaaaaattgtattaccttttgtttccatataaaatcctttcttttctaaagaaaaatttattttagtgtttgtttttttctggaaaaaatgtttattttctaattccttaatatattttgttagaactatctgattcttcacctgcccagcagaaaaagaaagtctcttatatgacaaaagtatggaaaaataatttttacttacagttgggtttattataaaatacatcatttttagggttgttcagatcagtgaaaataaacttatttgcttttatttgaataccaggaaaaaattataaatccatcattctttttgcctccttccttattcagtagatgaatgtgtatttctaaatgtttttccaaaacaaaacatctgaatagaaagtatagacattaaatcatagaaatacactgcagacctataataaagccagttctttagaatggtcaacaattttgctataggagagtaataaaagttgacttgcaactttactgttcatcctgctctgttttttctactattaacattgcaatttggagagtatatattattccaatgaactccaatggatttgtgggaaatttaactcttatgtctaatagctcatatgagctcattatcagacatcaatggaaacgagtgaccattcaaaaattttgaaaaagagcaccacaaattagaagtagtaattagccttttggaagcatttgaatcatgaaaagatatgttgcccccttaaatctcggtctcaaaaatcagaaagatacttgtgaagatttatcttgctgtttcattaaaaagcttgagaattataattggctctctcttgttttaaacattttttcaattaaatatatgattagaatgggtacatttcatccagagtattgcactgctgcttctttagtttcaatgcctgtgacaaagtctgagaactgatttgagagaggtgttctctcaggagcagctgcatctctctccattgcaaaatcttcaagcagtgttattaatggctttggagttgcttctgggtgtatgaaggtaatgagttgatgaactgggccctcttaaaatccttgttacacttttctttaagattctccttttaatccgagaaatttgtgcatttccacccattgcaaattgagtttagtttaaacccttcttatgagaaattacttttggagatccattcctgaagggacaatgtgatatttcccttgcctgtcataaattgacctccatactacaagcttagaagtgcccatctcgcataaaacaagtaattggtgtgcattaaattttctttctgaatgcaaagtaaaatgtataggctgtttgctgctgggttgaaaacacacattgttttgcattcgggtacataagtcttttccttgtgaataggagccagagtgattaaacaagcactcttaatatgttaatttataattttaattacaacaatcttgtatatatagtcattagtgaatactaatataaatatttttctacctttttattcataatgcataaaccaatcacccagttacttctctgaggttgcctgtttttgtttcataatacaatctttgttcttagttatgaatgcattttgttcattcctgtcttcaataatccctcattaagctagtcactttctgctccatgctaaaaaggaaaaattatcatgcaaatgtggcatgccatattaaaaagcacattaccaaacacttttgttgctgtccttcaattagtttcccttctttgaatttaattccatttgttgttaaactactgacttgatgtatggactcatgaatctgaggctgctgccaagaaagtggggaaaaaaaatcaaagcctcttcgaagagctgcagaggcgagctgaaatgaatttgcttcacctttgacaagaacacttgaacagcattggaatcctctgatgattcaacttggctaattatccaattatttatttcaagaataaaggcaccattttacaattaaggaagtgtaaagtagtctgagaaatttggtaatgacagatgacttaagtaacttctaagataaacagtatctgtgcaaaacttgtcccaccaattgttttcaggcagcagttggtgtgtcttagcatcagtgaaatcctgagtacactgaaggttttttgtttgtttgttttgctctttcaacagaaattattttacacttgtaaccaacatgtcaaatttccatggctcttaagcaatgtttaagttatatttctcttgattaaaagctttcggttcaaagcaatactttttaattgcctaatgatataagtcagttcttaggaaagaaccgcacatttaggagttcatttgcaatataactgaaaaattcattgcatggcagtaaaacaatttactgttaattacaaggagaagaatttgctgtagcatgctcgcagattgccatgaatcatgcagcactcctagagatttataacagatgtgtaaatgggatgaattagcagggtttaataacagagacacaaatcatgcagacttcaaggagctttaattgatatactagaatgtgacgggcatgaatcactcagccattcaacagcactgtaacatatggtcagctcaatatgccgcatcttaaatcggttggtgagtcgtaggttgtcccatatggtggaagcaatacatttttcatgattaaaaaaaagaatccattttttaaagaaatatgattgcaaagcatgttattgaacagtcttctgaatgccaaactgctttttttaaatgcttttttttttctttaacatggcagcttctcaaaataaataggggctactccttgtaataccagatcgctggaggcattataagaaccaaatcggtgcttgttggcacactcgatccacagcaagcctatagaaaagcgcagctgatgattgctgtgattgtcagggaaatccttcaggctggggcaaaacaaacaaatgaaaggatgatgtcactttcagagaagttcaggaatgcccagctttgtaaattgaagaaaatgagttggatgagagatccctgcttagcagggtaagaaagtggctgtgataaataataccatgacccctaaggtaacaattggatgtaacattttatactaacttcttaattaaatgctcagtcctacaggggcatgtgaaaagaagcactggctggtcatcacatagatggtagcaccaattccaagtcattcttgaagaattatttcagtatctgcaaacaggtaccctggttgaagactggtaactggtagtgtgcaaacatgtttttattggaactgggatctggcagcttttggaaaagcttttgctgcattagtaaatctgacagacttgaaaaaggaatattgcagccttagaactgtggctgccagaatttaatgtcaacaattaaaatttattttgatccttacctagtgtttattactgtttgtatacacaacagaccttactaatacagagatgcactattagatggaattaccatctgttcagagtgaaatgctggcatctgtcttagatgctaaaactaaaatgatattatttctaacaaaacaaaattaactgctttttactcaccaactttaatttgtagtgtgtagttgtatccaaggaaaaggcttgattttgaactatgtgatgacctctgtggccaggtctatatttagatatgcgactttatcaggggctctactggcctttttggcatatgaaaatggcatgtagaaatcacactttcaatacacaattatagcttcataatatactatgtatcctataagtcattaaaacaacacaaccaagctatgtaaaaattgactgaatcagagagactctactatgcaaaatattttgacagatacgccctaaaaaactgcaaggaaagaaattaaataggcaaaaaatcatctgaacaaagttgctataggtcccacagtgacatctttaggaaaatacaaactgtatctttcttctctgttagactattttaaattttctcccacatggacatatataaaaaatttacattcagtgccccctccttttaatttaaagcctaagtatcctattaaaataggtctttagcttttggaagttagagaatttggaggatcaaggacaatggtagtttccatactgatgttagatcagtgacgctactttctgagaagccagacttctattctatatatcacaaaataataaattgtgtcacaccagcatttaatgcatgtacacagtgcattaactgtaactgtagtacatttatttgtgctgcaggagacttgaaaatgatgaagaaatcgatactttgctgtcagagaagcaagtgttacgatgcatttaagtagttaattgcataagccccataaaagcttcaagtttgggtagcaaggatgccataattacagtctgagcaactaccttttattagtggtggactttagggaatggtggttgctgtcatcattgctgctatatgtgcagtttagaaataatggatcctcttctctcttcatgtgtaggatggtagttttgtgcaaattattgtgatcgccagaacaataactggttaaggtagtgtttgttcaccatgttcactgaacttctctaaaagcagggttttctttatgtcacagaacacatagacaaatcatatttgtatgccatgctaaggtaaaggaacaaggtggctgagagctgaaggggataaaccagaggggctcctgctggcttcccaggagcaaaggggatcaggatgtctggtacccattcgtggcttatgaacttagaagtactgttttaaattattcaaccaaagaattttgaaactggaagaggtcctagacataatcaagcctgtcactctaacaattgaagtaaccgaagaatagagagacctaataatggattaaccaatgttccataatcagggtcttaaagagccaatctagagcctacattttctcctttccagatcttctagtaatatcctctcctgaaggtgacttgtcaacaaagaagaaagtggcaaaatatattttattctttcttccctggtcagataatagacagtcaacaagatgatgctgagtcacccctgagagtttcgggggaaaacttttcctctttaagacactgattggtgagcagctgattctgcagcagtctctctgcaacagagaaatcagggctcatgacctggacttcttgtttgcgtcctggtccagtgcccttttgcaagtgttctggcctagcagtgtttggcaaattgtatttcctggcatagttttgcatttctgcgaaaaagtcaaaatcatattctattgacagggtgcttattaagaatgtcttatgtagtctgctccccacccacccctgaaacatagaaaaattgtttattcttaaattcttgtcatcatcatagaaagctgatgatgctttaagatattgacacagccatacagtcttcataggcaaaaaatgaacagattccttaaaaacaaatgaacagattccattttaaagaccagtacctcagaagagctttgttcagcttttagttcttatcctatggtgctcaaaatgctacactacataaattttgcaagtctaaatgtattcatttggatatactactaattatgttataaagtaataaatgctgcataaagaatgcatattataacattttataaaaatatctatacatcgaatagatagacaagaaattagattacccctattaaaaaatacaagtgctattttaaaagtacaagaattttgtacttttattcaaatagacattttattcttagaaatgatggataatgaacattcattttaaactttgtatattatccttagaaataatgaatattgaagattcgttttaaactttacatttacaagaattttctgggtaaatacagatagattttgaatatagatgaattgtattccttaatcatacataatttgaaagatttgttcttgtaatgatagcaccttatatttgtatagaaacttgttttctaaaacataaagcaaatatgtatattgttgtagaagcaattgttgtcaatgtatgtcactgaaaatgtatcctcatgttgcagatgggaaagtgggagcagatataaagggatttttctaagatcacacagatttagacattaaaaagtgaaatataatttttaaaagtctaccaaatccctttcattattcagtgttgtctcttaacgaactgttttgtaaattaacaaatctttaaaagtcatatctacttttacctatagttccttttccttgaaaatctgacgaataattcatcattaccccaatctcttggtgattctatgtgcatgtatgtgtgtgtgtttaatggttcagaagtatctatttttcttcttattctacttgtgtgtatgtgagaccagtctagtttaattgattgacaatttcacttaattcccccttccagccttagaagaactctgaaaagaataactcagtaggatgttcaccctttcaaacaggcttagttgactcctccatgtgaaactgtaaaacacacctactggaatgttttttgttttgtttttcttttaagcaagagaataaaaaatgtactctagttctattcattctcaggaattgacttctaaaggacagtcccattgctagatggaataattcctctgggaatcaagaagtgctctactacttaaagtttaaatggtaaacattaactttaatggactctcaagaatttccctattgattagaatcactttgccaaattaaaaaaaaagtgtgctctaattttcaataattattacacaaaaacgacagagttgccagaattccttttgtttagttttgtttcctattactcttaatctatattcctgtttaagacgtaatttttggattatgctactgatgggggaaggaatttgatttctgtggtggtgctgagcttcaacattatctccattgagttgagtggttggagtaaagtagagatgtatcaactttcaaacaaatgggacctggagaaaggctgctttcaaacagcaatgaaattcttcagcttttaagaagcataggaggcatattcatacttcttctcaacatttagttaaaatggaaatcctatcctcaacacaccaaatatgtataatttgtgatgctctgtctacatctttggtgtccagtatggtagtcatgaatcatatgtggctatttaaattcaaaatacagttaattaaaattaagaaatttgacattcagtttctcattctcactagctacatttcaagtgctcaatagtcttattataaggctagtggttaccgtattaaacattacagtcctagaacatttccttcattggagaaagttctattggacagtactggtaaagtagtttttggctattggatattactaggttagtagtttatgaaactaaaaagttcaggtttctgtgtcccaaaaccctagggaatctagcaaatttcaatttaaacattatgtaattggttctccattgcttccctgagcccaggactaaaaaatctttggcagctttcctttcctagttgagattatagccaagaatggcctgctaaaatcttaatacaaatatgtaactctaaactctgaagagagactctgggtgaagaaatttctgaatggcttagccttttattttgttttggattattttgaagtgagatcataacttgtagaatgaaatctttgagaacctaccatttaactgatttttagcagaaaaaaatgctaagagaaattatgcatataattcacagattcatacatatataaaaataaaatatcacatgggctgcagtggcagaaaataaccagaattgttaattatccttctaacttgatgaactttttgctcagtgccttttcttttttactaaaagttaaaatagaaccaaaatgaattgtttctttttgaaaagctggccgaaggtctaaaaagtaacaaatactaattgttctaagctgctttacggtgaatttcctttcatggtttaagggcttcaattcttatatccacatcattttgatttatatttattgaaacaggcaatgactttgcgtctgtgtatggctgtgttaacacaggtgtaaattgaaagtccacagatgtagtttgggcccttaataaataggctcggtgattatgacatttgttcctttctccacattcacctctcaaatccagcagacatacttaaagggggaataaatctcagctcacaaactcaactgtttaagggaaaaaaaaatcaaaccaaaacaaaccttcattttcaataaatcagctgttaatctgaatgagcaagttgtagggaaaaccttaatctccgtgactcctagggtttcccaggaaccttcaaagaattgccagtgtcccaccacctgaaaggatggcaaggtcccagtgtatgcaagggcatgaggtcactactgctccaaggctaagcccactgctggtggtggggtcacttcagggccagggtgctctctaggaccaagaggctgaccaaagttagttgcctggaccgttgtgtgtaaactgctgaactcacaggcttgttattttgtgctgatgctctgtttaacattcagagtgctattgcttgtttgctttcatttagatcagtttttaagctttaaaaatagaaaatagcgtataaaaggagcttttttgaccaaagaagatatacagatggcaaatacacatatgaaaaatgttctatatcatatgtcataaagggaaatgcaaattaaaataagataccactacacacccattagaatggccaaaatctggaacactgacaacaccaaatgctgatgaggctgtacagtagaaggaatgctcattcattgccagtgggaatgcaaaatggtacagccactttggaagacagtttggcagtgtcttgaaaaccaaacatgctcttaccatatgatacagcaattgcacttcttggtatttactcaacggagttaaaaacacaaaaccctgatatataattagatgtacacatatatatgcacatcatagcagctttattcacaattgccaaaacttggaaacaaccaggatatttcatcagtagatgaatgaataaataaactgtgataaactatgctacatccagacaagggaatattatttagcattaaatgagctagcaaatgatgaaaagacatgaaggaaacttaaatgcatattactcagtgaaaggtcagtctacaaaggctacatgctttatgattccaactatatgactttctggaaaaggcaaaactacggagatgagtagttacctggggttggggggaaggagagatgaataggcagggcacagaggatgttttgggtagggaaaattttctgtgtaatagcataatgatggatgcatgccatcatacatttgtccaaacccagagaaggtaaacaccacgtgtgagccccaatggaaactatgtactttgaatgaaaatgatgtgtcaatgcagatttatctactgtagcaaatgaaccatttgggtgccggatgttgatattggaagagactgtgcatgggtggggagatatggtagaactctgtaccttcttctcaatttttctatgaacataaaacttctcttaaaaattaagtctactgggcgtagtggcacctgtctgtagtcccagctacttgggaggctgagacaggaagattgcttgagcccaggagttccaggctgtagtgagctatcattatgcctgtgcatagccactgcactccagcctgggcaacaatgtgagactccatctctaaaaaaaaaaataaataaaggttacccctggcacattgcctatggtgtagccgtgctccacaggagcaatcaaaaacaaaaataatgaaagtctttttaaaaatgactttctgatgtatttttacacaagcacaaagttttggcaaactcgtgttaatattccttcattacccattggttggcacggattatgctttgcctgtgtaaattacagcacggagttgatgcctctttaaggcaaggggctctgccctatgggtttagtgctagtcattggctgtaggtttcactgcgggatcctgtggctcctgggtgaggcagctcttactcagccaagggaagttctacgcagaagggggcagccatgagccatcagaaaccaacgggcacagaaactgggccattggggtacctgcttggtagagggactgtggttggggcaccacccagagtacagcagctactataatatataagatctattatttagctaaaaagaatagagaagttattttcaagaaaaaatttaatttgaaagttttgtgtgtagtatattggccatttaaattttgtttcactgcatttaagataaactctatattgtgttttcagttcctagagccatacagatacttgaaaccacaactgatttgatttgaagtgtgatatatacaaatacatatatacgtatatgtgaatatgtgtgtctagagacagaaaccaaattcttgaatataacaggtgttttctaatatttagcaccagcacaactgaggccacctctggttaaaggaatcaacagcacaacaatccatcttaggtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggtaagtgtgtttgacattgctttatttaggagacacgaagctccaaaatgttttctatattttcatatccctttacaatgaatttttattatacctacttagagaaatactaattcagccctttgatagcttttgcctgattgtttcagcatgtccatctttttagaattctggggaaaaaagtcaggtaagtgaaggaaaggaaaaataaaagatgaagatgaagaagcagccttattggatcaaagtatgtgctttgtatttgtctttttgtgaagtatgtgccaggacatgtttcttgaaatattattcactgtgttctctgagcaaatgagtttgcaaaatgccctcatgctattggagattctcagtatgcaccccgttactgaaactccaaaaagcattgtaagaaagctattcaactttgcttagctaatcatgcctaacagatatttgatgtaatgttttctttttctttctcttgctgtttccttcttctttttttcactgtgacaacttaatatctcatgttctatgaagaacattgtggggaaaactaatcccagggaaaagataacttctctaagccaggactatggtaaagcaagtgaggctcttgtttcggtcacaaaatttaaaggcactaaaaaactcagtgttaatgtaaattttaatgcaatatttttaaaaatgaaaatcaatgtgaaagcactataaaaatattatcaaaagcttaaataaagacagattgaactctgtaccagcacaatcctgcctcactggccttaccctcctcctggccttactagtaccgcaatattttggaagtcccatgacctctgtgacttacagcttctaatagcatgatttcaatatagctgtaaaaaaactctacttatggtacaccatttttccaatttttaaaaaaatttacaaagtataagatatatattattatgtaaactcataaagatgttcatttaatcatccatgagaaagtcattttggagcaaatagctagtctttaaaatattgcatatgtgaagacaatgaaatggaattcgagctataaaaatttgtattgttttatttttacttaaaatagtaaatagtttgcttttcattgagactggctgctgatgcaccttggtaatgaatcatgattatattctaactgagatatattgagattaatgcatgattaactactctctcagtacatcaaaatcattgcagagtattagaaattgaaccattgagctaaaaatgctcaacttctgctttatattcttaaaatggcaaaaaagaaaagaaaaaaaaggtaaggaaaaggaatacatgaataatagtaaaactcttttctcaaatgaaaatggaaactacctccctgatccaatatttggcttgagatgtgtttcttccaagaaatagcatccgtttccattcagctgggcatagctgctgcaaggatgtcagcttggatttgcaggctagccagcagacagatttttgatgggatcacctactgttgttgcagtgaaagatagaatggcccgtccaccgttaataaatttggtcatcctcgctatctcccttgctggccttatactctgaggtgcaagggctaggggcagatgcagtgtctgggaagttttccaaattcctctttaaaaaagttaggctgtaaacactggcctcactaagcaggatccttctgtctataacaaagcctccagctgcacagaaaatatgcttggagtacacaccatttgaaggacaaggcagggagatcacaattttggcttgaactactccctggagctttggtgattcctggagaatgagaagttcttctgtgttcaggcatgttctgggacattgctgatgccctttttagtggtagcttggctttacttttaagacccctttaacttttaatataaccatgtatatactaagttattggtttgatcctttggctgacttgccaggtttggctgaatgattttattgagttgtaccgaagcctaactaaatgtacccaattaatgagctaggacaggttttcaaaaccaactcaataactttctgtaaacttgcatctttcctaaatagagaggtaagcatataattagcatcttacattattcttactgatatattatcctatttaatccctctgcaaccctataaagtagctctttttaccctcgtagtacaggaggaaaagaggctccagtgagtgacttgcccattgtgccacagctattgaatttcagggtggaaacgtgaattggagccttccaaatttaaaggcaaggtctctgctacagggtggaaaggaacttttgtagactgttctttggaagtgatagaataggaagtatacaaaagtaagaaagagggataggaggtgaaataattatcacccaaatattccttatctgacactgctaaactttttggatttgtctttcagttagtttcagctcacaaacagcaagtagtgttggcattatttattcatttatttgtatccccaaagacatgtaggcatcaggtttttttttaatagcaattaaacccagagtgttactagaagctagatgtttaaaatataaataacattatgtgaaatgggctgaagtgttatgcgttaaaacagtgctttcaactcacattcctttatatttcattcagtttttatattctgaggcaaatttaatgagcaaatccttgaaacctctaatatgatgaattacattttaaaagttaataactttaagataaactaagatgtcctttgttttgaattattcaattcaaaatctcaaacttcaactaaaatgacttctgaatagaaatatcaattagtactcaaatacaaatataaggttgatgtacataattatacatattttatatatgaaaagataagttagattgtacccatcaatgacaggaattataaacgcattcataacacatttcatggccatgaacattatgttgcaagtctcagtaagaaatatctcattattgtagtacaagaaagggatctcttacacaacttatgcctctttcatatttgctttaaatatttttatcttacacaatagaaagagaataattcaagcatatgaatatatgtcctaaaatgttgtttaatattgtaaattaccaagcttaatactgtaaataaaccctgtcaatatctacctttgggcagaataaagaaccagataaagctattttgggacctatttttgcttccttttcttttctgatacaagtgttcttttaaaaaatctaatcttcaggaagaatgtattatcagtcatttacatcatagtttaaatttaaaataattaactctctgtatattattatgaggacttcgaagaagattaactgataaattactttcaaatccaggccccattatttattagctaaatgtaattagacaactcatttaatcattttttgtgcttctgtttccttttctttaaaattaacataattccactgacagtattggtatctagcaggtaggtgaggatttaaagtagatagcccacctaatgaactttgcacagtgcctaccacacagattatttagtactcattaaacattagctattagttattattcatttaataaatatttattaagtgcctactatgagacaggagctttcctaagtgagagtattctgcagttataaaatcagcattctattaatttatttgctgttacacatgcaaaatatgtttgctcaaatgttatatctagggcatgagtaatatgcaatattccatattaaaatgtgatacttaattttgctattgaaaatagtaaaattaattgacttagtggtgaggacttgggcaaactacttttctgagtgtctaatcttgctcatctattaaattgaggattttgttgcatgatcaatgttctaacctctaaaattccaattctgtgaacatagaatgtttaggaggccccacaatccaaaatacaggctgtaatcatggcatctgtgagttaaaaaaacacctagagtttaaaataaattgttttctataatattttgtttattaatacaatttaagattgatacaaatttactgcttttctctaataatttaagaaatttagtgatatgggcagagttcaacataaaatagatattcaattattgggtcatatcagatgttataaaaaaagcagaaaattaaaatagtttcgtgatcttgtaattgggcaatgatataaacaatcatggtgaaacagtgccccagttacatggggttaaaaatactttcttcttccaacacagaaatagcaaatagagcctcccctcccatatgcaactagaaggggatatcattgtgcctttggagagaaaaaaaaatcatgctcgtttttttcaggaatgcagagtaaatctacttgatttatacaaagaatttagttctttccttgtaatgctagtaatccaagtggaacctggtaaaaacagcaagtaaaatactgctcagattggcattccaaaggtgaccctctttctccttgtcacttattttttcctattagcgaaaacaggtccatgatcatttgggggaaggtttgactattgtagtatccagatgccaatcacaccagccttttaaactgcctttactggtgaccctgcccagaaatcaggaactgcctttggggagatctttgtagcaaaccactggggagatgagcacacacatgcacctggatataattcccttttatttgtcttcacgagaaatgtgattactgatgttgaatatcttgcagatgagaactctatacagtttcttcataataatgatgttcaaggacactaaatgattgtcatacatttttgtatcatagtattcaccttcccaaaaatggttgaactaaaatgctttagaatacgaaatgcaattaattaccaagggatgaaaaaagaaatgcaaccaccaaaaatcaatatgtttaagagcatattctttatttcttttactccataatatttatgccttattgttattagtcttcttatttttagtgaattgggacatttaagcacttcattaaaagaaagctgattataagcatttatagtgaaggtgcaagtagggcaaacttcttcagatagactaattagtaaaagcatattaattctgaccttcaacacccttggtgtcccactatttgttttccttggagtgggagcaagtattttgacagaaagcgcttgaaaaaaataaaaaacaaaacaactaaacaaaaccccagttcttttcaagacagatttaaatcacaaattttacctaacctttgatgttagatttcagccctagttattgaaaaacaaatataataatctactatgtgtcctagaagtttaatgaacaggcagtaattatactaaaaaagtaaaggaaagagtaagaacatggtatgtggcagcaaagtaaaggagaaataattctcaggcagtgacaaaactctgctgtgttttctgattatgaaacaatcagaagagatgagaatggttgagttaatcagtttggactgaggacaaggatcaaaatgcatatcttcttagaataacagaagtcacactgactcatgataactagagatatggagatgtaaatgtcaagactgtttattttttattatatttagtagagaggtataagtaagttctcaggaaatgccttcaggtggcattgatggcactgcgagatgggagaggaccattatttccccattcatcaactacatcataagaccaatttaagaatgcatgtgttttaacccttgccttttaaaagtgacttattttgaagtacattcctgtaagtctcccttttttttgaaatattaatgttaggtaactggtaagctgagccaacactgaaaacaaactgtttttgttagctgttagcagtattttagttaacttaaagcatctgtttttgtccatcactgttaaaatttttcaaaatgcattgtcacctgatatataaaccacacgtgtgttcctatatactcatcccacatgcataaacatatgttttccagaaggtctctgggttttccgcaaccactcaatgggttctccttgcccactgcctagacagagccagtttatcaagacaggggaattgcaatagagaaagagtttaattcacatagagcctgctgtatgggaaacttgagttttattattactgaaatcagtctcttggagagtttggggatcagagtttttaagagtaatttggctggtaaggggttgggaagtgggagtgctgattggttgggtcggacatgaaatcctagggagtcaaagctgtcctcttgtggtgagtcagttcctgggtgaggaccacaagatcagatgagccagtttatcaatctgggtggtgatagctatttcatgagttaagggactgcaaaatatctcaaacactgatcttaaattttccaacagtgatgttatccccaggagcaatttggggaggttcggaatcttgcagctggaggctgcacggcttctaaaccatcattccttatcttgtagcaaatttgttagtcatacaaaggcagacaggtccccaggcaagaagggggtctatttagggaaaaggctgttaccatctttgtttcaaaactaaattgtaaactaaattttttcccaaggttaggtcaacctttgcccagcagtgaacaaggacatattagagtttataagtaagatagagttatttaggccaggtctctttcactgtcataattttcttagttataatttttgcaaagtcattttcatttctatatagtctcaaatatacctgctcaaattgtccagtgtcttttctgccagtatgttggcattttggaatcttttcaaagacttcattgcttaaaaaaaatgctgttgcttaatgatattttgtatcaatataacacattaattttaatttccccttcattcagcttaaatgggttggaaaaggaactttgagcagaaaaagaatcataattggtcagcaatggtagtgaaactagcacctttgaagatgattgatttttgatttagtaagatgaattattttgtgtatgttttcttgaaaaaaattagttaaaacatttaaaaatgtatagttatagttattttataccagttacagcactcttgaagtgtatagattaagttcctttctattcagatagagaggaatctgggaacatcattgtcaaaatgccatctctttcaaaacttggttccagtgctctaaagaaatgttttagaagattatgcactaatgttactggcggcaaattcatatagatctgtagccacctcaatttttgcattctcagaagaaagaatttgattgaggggacataaggcatattaagagaccaagacaaattttagagcaagagtgaaaatttatttaaaaattttagagcaggaatgaaaggaaataaagtatacttggaagagggccaagtgggtgacttgagagatgatttgacctttacttggggttttatataatggcatgcttccgaggtcttgcgtcccttctcccctgattcttcccttggggtgggctgtccacgtgtacagtagtctgccagcaattgggagaagttgaatgtccagtgtgtttactgaagttataggcatgctcacttaaggcatgtttccttgccagttaagtgttcccagaaggtcatataccggttaagcgccaacattttgcctcttagtgcgcatgcttgagcccactcacccatctcctgagatctcattgggaagctgctgatcacccgtctcaggtgtttctatctatagggagactgcctttccctggcactggctgtgactgattcttattattttagagagatagtgtaacaattatcacctgacggttgcctgacatttctggtggggcgttgtggggggcggtgcttctctgaccctgcccatagtctaactgccaactgtaacactaacagtttcattgaagtgggggaaatgttaagtaataatatgaaaaccatatttaaggtatatatatataaggaggctcacaaacatagccataggccgtttgtttggagctttgaaaagggaggctcagttccttgactgatgagcagtttccatttggaaattctttgactttagtgcaacttcaaaataaaggcatgagacagaaggagagaggaagaaaccctcaagccatctaaagtcatctctggcaatggtggccatatcattttcacaaaaaaggggcatccttggggaatatcataaaggaagaataaggacttaagggaaatgtgtgggaatgattgactgatcctccctccagcagaaaattaaaaatcaatgtagatgcatttttctcagcttcttcccttcatttttttcctctcctgaaacctgttcctccttccgtgtgtaccatctacagtgaatatcactattgccttaggcggaaaccttggaactctccttgaattggcacttgaactattcactcatttcctcccattctattaatgattcctcctctggccgttcttcctcggatacatctcttggaactacctgctggtcctacgctactgcctagtccagacctatgttgtgggcttctctgccaacagtttcaatcttctccaggctgttcttcaaacgaattatttttattggcattctcttgtgtaaaaccttttaatggtttcccagcgagagatgcccttcacaaacccttttctgcttacctgctttctacctatatacctcctcatctctcccaccaaggactggtatactctctagctctagaccattttttagtcccagtgcttgaatatagcacactctctcagatgcccatctctttgaacatattgatacctttgccgggtatgccctcatctatttgcaagtacttcgctttcctttcacctggctaattgctactcatcatgaaagggttagcttagctgttcccctaaataaacttccagcaaccccagcctcctcccatgccaaatctgggttgaggacctctcttatgtactactatagaaaccaacaattactctattttagctcttaccgcattctattaagacaggttgttcagggagctaagctatgaggacgcaaaggcataacgatgatacaatggactttggggactcaggggaaagtgtgggatggggtgagggataaaaaaaactacacattgggtacagtgtacactgttcaggtgatgtgtgtaccaaaatctcagaaatcaacactaaagaacgtattcatataaccaaatactgcctgttcccaaaaacacctgttgaaaaaaaaaaaaaactggttgtttgcttatctatgtttcatgtagactgaaattatgactatctttttcatgcttaacacatttgtgtcttgcacggcataagacatttaccagatactcaataaatatttattaactaaatgagtgatagaaaagagggaaatccaaaagatggatcacttagctgtaagaattatttaatggcaaaattcattatgcttttgaatatagttcacatttttaaatccacgtttttgaaagtattgatggtttagagtgataactcaatttgtttagtctctattggccttagatgtgtaagaaaatacattttaaactgtatagtaccagagacaaaaagaaatttcttgttaatggtcctcagttgctggcaaagttacttgtacaccagttgttatagctagagtgttatatcagaaattgttttctgccccaccatagctatcacattgtgttgctgaaaactaggtggttgcacatctcttagatacatgatctccttaggcttattaaattttgaggttaatgaatattttgacacttttacctatacatatcattagggcttattgcaataggtttaagatgacagtcataataaacatatacagtacaataaaaagcacttttaatcttgaaagtgctttaaaaacaacagtgatcaatgctatggatggattaacagcatcatgctgattgaattctatttcaaggacaatggaggtattgatgttggcagtctagttcagaaagtggcaatggctgtagtaaatggtgcaggttctggagtcagactccccaggtttcaaatctggctccccaacatgctggtgtgcgactttgcacaagtcattcccccagtgtgaaactcagtttcttcatctgttaaatggcttattgtaaggtttcaatgcaatcactgtaaaggattagtacacagtgtcttagtattgtgtatgcatttgtgaccagcattctgtaattctggacttcaattatgtgcctttccattgcatacatatattttatgtccctaagtcacataaatcttgttgatacttctttatgacctctctctactacacggtactctgatcattcactttattttactcattctgtgaacctctgacctgttttttgttgtcattgttacctttcttcttccactagaagcatacatgttctgcatctcatttctccacatctatttaaacagccaactttaaatgttatgtgtacttataaacctaactctattattccccctgtcttcataatcagtcttctcgaaaactaagactctctatgtgtcattttctcatggatcaattactcctcaatctactgtcatttggattcttttcttccacttctttattgtaaatactttcttctagattatcaatagttttcaagtcagagaactttccttaatcctcaccctatgtgccaataaataatattggtgccattttttccttttaaaaaataagaagaaactaaatatttctcactaggtttctccttctattttccctaaactgtgtttcaagctttgatattgctttctacatccacctttaaatggaagagttcaatcactcattcggttcgtatgcagtttttccttatttcactccactagctgatgttatgattgctgtcgtaaaaaggatactgagcaacacaagaatgattcctaaccttagggagcttaaagtcttgcagtgaaatcatgcatcaaacatgtaattaagtaattacaagtgacttctgtctccagctatgaagcatatcaaaaaatcctcctgctgagaaaagaaatagaagctggaaaaaatttctcaaaaatatggttaaagacataagtgagtaacaaaggcttctaggacttgtgggatcaagatcctagatataagaaaaaccatgtaggtgagccttttaaattatctttgtttttccttctgttttgtttgttaattcctctattgcatagtcttagggaaaaaaaaaagacaggcaaaaaattagagtctaggtggggtcctggtatacatgccaggttttcaattgaaatcctagaagagcaaatcattaataggctcttcttcctcagataaagcctcaattattcttaactactaattatactgagataaaagttatttttttaccaaaaatatttagatatttgctgaaagatcacatcaaccagagtcccagagtgtgcaattttttcctatacaatgtcgggcattcaatcaaatattaacaggcataccagaaaatagggccaaataaccaaaagataagataaataaaataaaaaatagaaacatatcctcaagtaattcagatatatggaaatatgtatttgcatacacacataggcatatacacacatatacatgtagatatatatgcatatatccagacacagactttaaaataactataattaatattatcaataaaatcaatgaaaatgttcagaatttaagtagcaaatgggaatatattagaataggaattttagagcggagtaacagctgaagttagcaactcagtagataaaataccaattccatccctgataaagtaaatagccttgttcttaatatcgtatgcaacaatgtaagttgggaacaaaatatatatgaaacacctatttgtagccaatatatagcaacagtgcagagctattatgcttaagtgaagaaaagcaaatgaactgagttgcacacacctggaattattgagctcaagcagagacattagtatatctggtaaaggaataaaaactggaattcagggctacaaaagtagatttggagggtaggttcccagagagaagattgatgctgaaaaataattcaaaaattctgtgtaacaattcttttttgggtgcttggccaacatttagaataatcctatgagaaacatagtagagaagatctgcttggtagttggagctaagtagagatttcacaggcaacatagagctaaggatgcacacatggagtttggacttaaccacagtagagaaaccttggtgaatactctgagctttcactcgactctccaaaagtccgtcctttatgagtaaattcccatgctttaggaataagggctattctttaggaacattgagataattgaaacagattcaccctagtgaagcctaaagccaaggctgagtaaggtcgaggtaatctggtaattttacttcccgtcaaaacagaattttgtattcattagtaaaaggtaaaataatccagaggttttactatgcgtcatccatgaagtgaccaataatgaaatgttaatagtcgatagaggcagacaaagacttcaaaataacttcagttaatgttaagagaaaataaaggacaaggtggacagaaaggatgataagataaaaaatatttcaatgcaaaattgaaatctgtacagtaattaataggaaaaaatggtatgtaaagtaaaatacctgaaatgaagagaatattgataagttttgccaatgaaacattgcagaaggcaagattagagaactcaacggtcaattgtaattgtccaaactgaagcatatcgagaaggaaatgaaaacatgaaaaaaagaacaatgaggtatttgaggacccagaaggaaagagtgaaagaatgagacaatagtaatattgtagaatagccaaatattatcaaatatgaaaaataagttcacacatagtttaacaaagtttagcaaaccataaggagggcaaatataaggaaagccatatccaggtatattacagtcaaattgcttaaaataaaagacaaagaaaaaccttcaaaagcacctggggagggtggggagacttattaccttcagtggagcaaaaataagaatgatgtctgagttttcaacaacaacaataaatgaatgccagaatataatggaatgatactttttaaatgctaaaattatttttttaacaataataacaacaaaagaaaactaccagtcaagatttctgtacccaggaaacatatccatcaaaaatgataaaataaaatatttttcttaacaaaagagttgaaaaaagttatcatcaaaagactggcattataaaaatcataaagtgtattaggacataggaaaagatcccaaaaggaagcacagagctgcaggaaagagtgcaaacctctagaaatggtaactaggtgtgtaaataaaaagtaatatttatgataaaaggcataaaaatcatactttgaagttgataacatgtaagaaaaaatgtatgacatcaattattttgtcacaaatgatgacggggtctatatggagctaaactgtggtaaaattcctaaaaagttatggaagttgaagaattaataatatgaagtaggccatagtagatcaaggattcagattatgatgccaaaggtaacaaccaaaagaatgatttagaaaattaatgtaaggaaacactaaatgttaaataaacacaggttaagctgataaaggagtttgagggtggcaagaagaagccagaaacaaagagcaaatgtggggaataaaaggacaaataccactgtggtgaacataaactcaactatatcagtagttgcattaaatctaaatagtctacccaaataagcataaaagttctcagattgatttaaaaaataaaaatatatgttgtttattcttataaacatactttaaatataaagacaaaattcgaaaacaaagaaagagataagatgtattgatatatagatagattttaagacaataaatgttagtagacaaaatggaggacatttcataatgacaaaaagatcaattcaatagagggacatataatcctaaatttaggtgctacttatagtttcagatatgtatataaaactgaagttgacagaaataaacagagaataaatatatcctcatagttgaagatataaatccccatctaatattttgacaggaaaagtacacaaaatattagtataactatcaaagatttgaaaatgaataaacaattacatctgtatataaaacatgtgacattttataagtgttgtcatatgtagaacatcacttccaacaactatataatatgcatttttgaggaacacataggacattttccaaatagttaatatcctgggctatagaaatcgcataatttttttttttaagagacgaggtcttactgtgttgctcaggctggtcttgaacccctgggctcaagcagtcttcccacttcagtctcccaaagtgttaggattacagatgtgatgagccactgcattcagcttgatctcataatatttcaagttctctgacaactgtgagattaaactagaactccaaatctaaaacataatccgattggaaaatatccctggctcaaaaagaaattatggaaattaaaaattatttttatctaatgataataatgccttaatacatataaaaacattgtaggatggacaatatcaggaatctgatattgctttatagctttaaatgcatatattagaaaaagggaatagttaacaatcaattagcttcccactcaagaagaaaccaggaaattaaagcagcatatgacacccaaaaaatatttgaataaaagaaattataaaaataagagaaatcaatgatatagcaaacagaaatgtaatggagaaaataagaccaagaattgattctagaaaatttggggaaaaatttctttgcaagtgatcaaggaaaggagaaagtacagattactactctcagggatgcaaagagccattactagaaatcttacagacattaaaaaaaataataatgtattaagaacagcactacgctaaaaccttgacaatacaggcaaaatacagagatcctttgcatgggagaaaaatctccaaatttaaactgacacaagaagatctagaaaatctatgtggtcctagatgtgttttaaaaatgaaatctatagttaagtcttttacataaagaaaaccccagggaaggtggcccgattggtggatttcatcaaacaattacagtagaaataatagcaatcctacaaaaaaactcttacagaaaatagaaaattgcaatggtttctatctcattttatgaggtcagaagaacttatacactaaaatctgacaaagaaattaacataaaggaaaacacaggtcaataataatcacaaaagtagattctaatattctctgtgtgtgtgtgtgtgtgtgtgtgtgtgtgtgtgtacataaataaaatgttatatcatgaccatgcaggttttattccagtagtgtgtaatcttttcaaaatgtatgtgattcaacacattaacatagtaaaaatgaaacattctaaattatcaccacagatttaacaaatgcatttaataaaatataataactattcataacaattctcagcaaactagtaatgaaagaacacatcctaataaattgtttttgtaaaagacctctaatagtaaaatatcaagtgctttttcccagaggtcaggtacaggacaaggaaattcactatcaccacttttatttaatgttgtactggaagtatagtactagccagagcaatatagcaataaaataaataagtattaggtatgtcaaagaagaagtaaaccatctttatttgtagatgtcattatttttattgatgtcaaaataatatataaactattcagtttactcagtaaacttagaaaagtgtcgaataaaggtcaatgtacagaaatcaaatgtttctattgaatagcaaaaaacaagtagaaaatgaaatgtttaaaagtaccatgcttactagaactaacacacataaatgacttagaaacaagtctgctaaaaggtaatgtaggacctccactctgaaaactacaaaaaattactgtgagaaattaaagaccaaataaatggaaagttacgccatgttcatggatctaaacacttaatattgttaaatagcaagtcttcctagtttgatctgtagaatccatatagtccctctcaaaatcccaggatttctgtaaaaatttacaagctaattttaatatgcacatgagagaggaaagtacttagagtagccaaggcaatactaaaaaagggcaaagtaggaaggcttatgtatcaagactaactataagactgcagtaggtaagcatgtatagtataggcaaaagaacagataagtatagtaataacatattgccacataaataccccaaataaatacatatatatgcagggcacagtggctcacacctgtaattccagcactttgagaggccaaggcaagagtattgcttgtgctcaggagttcaagactagcctgggtgacatagtgagacctcatctctacaaaaagctgaaaaattagctgggcatggtgaggcacctgtagtcccagttactcaggaggctgaggtaagagaatctcttgaacccaagagttcaaggctgcggtgagccttgattgcaccactgcactccagcctgggtgacagagcaagatcctgtctctaaaaaataataataatacatacatacatatgtgctctaaaaagcacatgcaaagttgttcatagcaactttatttctaataatcaaaaactggtaacaatccaaatttctatcaacagtagaatggataataaattataataaatttattcagtggactgcatatagaaataaaaatgagccaactattgcttcagagaacaatgtgggtgaatcttataacctgttagtgagtaaaagaagctagaatctaaagagtctagtattctatttatataaatttcttctttttcattttaacatttattttaggtataatgggtacaacatgcgggtttgttacttggctatattgcatgacgctaacgtttgggctatgggttccattacgcaagtagtgagcgtggtatccaataggtagtttttccaattacagtcccctccctcccttccagtgtctgttgttctcatgtttatgtccatgtgtgctcaatgtttagctctcacatataaatgaatatgtagtatttggttattgttccagcattaattcacttagaattatgaactccaactgcatccatgttgctgtaaaggaaatgattttgttcttttttgtgattgggtagtattccatggtgtatatgtaccacattttctttatccagtccatcattgatgggcacctagattgattctgtgtctttgctattgtgattagtgtagcaatgaacatatgagtgcatgcgtctttttggtagaatgatttatttttctttgggtataacaggattgctgtgtcaaatggtagctctgttttaagttctttgagaaatctccagactgctttccacagtggctgaactaatttacatttccaccaatcgtgcataagcattctctcttttccacagccttaccagcatctgctgttttttgactttttaataataaacattctgactagtgtgagatggtatctcattgttgttttgatttccatttctctgacaattattgatgctgcacattttttcatgtttgttggttgcttgtatgtcatcttctgtgaagtgtatgtttggctgggcgcggtggctcacacctgtaatccagcactttgggaggccgaggtgggtggatcacgaggtcaagagatcgagaccatcctggtcaacatggtgaaaccctgtctctactaaaaatacaaaaattagctgggcatggtggtgtgtgcctgtaatcccagctactcaggaggctgaggcaggagaatcacttgaacccaggaggcaggggttgcagtgagccaagatggcaccactgcactccagcctggcaacagagcaaaactccgtctcaaaaaaaaaaaaaagagatagaagtatgtgttcatgttctttcccattttttaaatggagttgtttttcttttgttgatttgtttaagttccttataggttctgcatattagaactttgtcagatgcataatttgtatattctgtaggctgtctgtttactctgtggatagtttcttttggtgtgtgtgcagagacactttagtttaattaggtctcagttgtccatttctaaagctgcaaagtgaaatcagtggtgacagaaatcagtagatggggtaataactgaaaggaagcaaaaagaagccctctgagattctggaattattttataaattagtctgagaggagtttataagtgtagatttattttgtaaatgtccatcaaaatataccttgataattagtgcactttatttttgttatactttactttgaaaagttactgaataaatgtttcaagcctgcaaagtccaaaaataagatgtgaaaaaatactgtaacataacagaagcactcaacccagtctagaggattagtgaagacctctccgaggatgaggcaagttgagttagctaggccaaaaaaaaaaaaaaaaagaaaaaaaaaagaaagaaagaaagaaaaagaaagaaggaaagtaaaggagtccaggtagagaaagtatcatgtatcaatgtcttaatgtgggagatgacatgtacataaataaacaaattagtaagcaagaaaaacttggaaattctaatataaattagattcttgccagaagggtgcatggtgaggctgaaataaaaaaggggccagatcatgcaagggccatcacattgaaaattttgaacgtaattttattcatctttataagaccactgtggaggttacagcctgataccaagaatgtttttaagaagggcatgctgatattttcactgatattgtacatgtaccattcatagattgactcactaaaagttgcaattttatttaatcatctaataagattatttatagaatgtctgcaaaatgttagaagatcttccttataagaattagcatagctgaatggtttaaaaaaaaatgaaattctgaatcccagcatggatctattgcattcttgcaattgtccaaggcaaaaggttctgcttgcctgcttcataaacaaaatcaattaaccgagactgcagcattgcagtaaaaagtttaatttaagccaagccagccaagtggaagaactggagttatcactcaaatcagtctctctgaagtcttgaaggttaggatttttatggataatttagtgggcagaggggctagggaatgggtgctgctgataagttgaagatgaaatcataagagcatggaaaatggtcctcctgtattaagtctgtctctgggtggggcaacaggatgggttgagtcatgagtcattagtccaggtgggatcagtttgaaaaacatctcaaaaaagcaatcttgggttttacaatagtgatgttatctataggagcaattggggaagtcaccaatcttgtgacctctgaccacattattcctgaacagtaagcaattataaaaattacacctacattttagcagcattcaggcccctcccgtaatcctattcttgtggcctttcattagtcttatgaaggtggtttttagtctctgagaagggaggaggttagttttagggagggatgatcatctatgatcatctttgctttcaagttaaactatgaactaaatttctcccagtgtccaggaatggccaaagacagcttgaaggttagaagcaagatggagtcaactatgtcagatttctcttactgtcgtaattttgtaaaatcagtttcatcctaatctctggagaagtacctagaaatttgcatttggataagatatacagatctacactattaaagacagagctatcttacccacccccaccccagctatttgtctaagggaaatgaaacaatttgtacatacaaaaggctggcacacacatacgcattgcgcctacattcacaagagccagaaactggaaacaactcaaatatccatcagtaggtgaattgattaataaaatgtggtatatgtatgtgatgaaatactagtaagcaatacaaaggaaagagcagaagaacacttaatcgtaattccacttatataaaattcttaataataattaatgtatagtgacaaaaaggagatcagcagttgcctaggcctgaggaggagggggtgatggaaatgctgtgtaacaatcaaggtagtggttttacaagtgtgtacatctgtcaaaacatatcgaactgaaccatttaaacagatgtgcttcagtatatatgtaaatttttatctcactaaaattaataaaatattctccaagtgattcttgcaacattcaagtatgggaaccattgatttacactgtaatgaacaagttgctttaactttgtttggaaaccaaacaattttaatattattttaccatttaaattctgagctctttcagatagaaacttaagcagtgtgtatactgcttatcactccaaatttcacctgaaacaaattggtatatactgtttgtcataaaaataagaaaatgactttcattaaattatgctgacaatgagaatcttgtacaatttcaatgaaataactttttttaatgaaatagggtttcttttgatctcattcacattcagaagggaatttttgtaaatagaaaggactatattttattttatcctaagaaggaatttagtcagtaaaaatatgaaatagacacttgagtatacagttgaccagttattgccttgaagctactgcacctctgtaatgtatttttcatagcttatataatccgtgttaatatgctacattattaagttcaactgtgagaaatatagttgcttgaaaacagatttcttctgcatacttataaattcagtagttggaaaaaaattaaagaaatataattaaagattgcaaaatcaatttgaccctcacttaaaatgtgttgagtggaggcagcaagcagcagcctacatctgatgctgttctctccttgtttacttcacaaaactgtgcaaattagaactttaatttacagagctgttaaagcctcattaaaaactttcagcaagtatcctattttgagggtttttttccccttatatctaatatgcagcattatctctgttttgtgggcatgtatgaggcaatatctataggcatattaatgtaaactgcatatatgaaatgaaagtttttcacatggaaaggacactagtggtgtctgtcaattgcttcccaaagtgattaatttctccatttacttggtgtttattggcatctactaacactggatctctgttggatcataggaatataattgggctccagtgaaatgggagaattccctgacaccctgttgcaggatatgtgacagaggtgtggcttgtctgcttgaccgccttgcactcaaactccttgcaggagagggagcatgcagatgggcaggtgtgggagccagggcaagaacttttgggctccagtcccatggtagtatctaggggtgggtgcttgtgactcccaaagccccagtgggtgtgttacaatgcccttttagctgtgccatccacatatggcttaagtgttaaccagctcagtgctttcttggtacctgggttcttgtccggtgtccaagaagaatcaggttacatggataaactgaaggatggtaaatgtgggggattttattgctggatggaggtggctctcagtggaatggatgggaaactggaaaggggatggagtgggaagatgatcttcccctggagtttgggcatccggcggccaatctcctctctgactaaccccagccgaaatcctctcaatgttcagatgctccttttcttctcttcttctatgtggcactgctctgctattctcctgttcctctgctcttctgctcatggagcctggggtttggggtttatatgggtataggatagtggggcatggtgggccaaaaggcaacacttgggtgtgaaaacagaagtgcctttttttatttagggctgtgggtttccaggcttcagggtggggcctttgccagggaactgccctcttctacccagcatttccctgcctcctgtctttatcaccagtagacttgttccctgctcttacaggatttcatgcgtgtccgtgtgaagagaccaccaaacaggctttgtgtgagcaataaagctgtttatttcacctgggtgcaggcgggctgagtctgaaaagagagtcagtgaagggagataagggtggggccgttttataggatttgggtaggtaaaggaaaattacagtcaaagggggtttgttctctggcgggtgggagtgggggtcgcaaggtgctcagtgggcaggagtgggggtcgcaaggtgctcagtgggggtgatttttgagccaggatgagccaggaaaaggactttcacaaggtaatgtcataagttaaggcaaggaccggccatttacatttcttttgtggtggaatgtcatcagttaaggtggggcaggacatattcacttcttttgtgattctttagttacttcaggccatctgggcgtatacgtgcaggtcacaggggatgcgatggcttggcttgggctcagaggcctgacattcctgccttcttaataagaaaaataaaacaaaatagtattgaagtgttggggcggcgaaaatttttggggggtggtatggagagagaatggacgatgtttctcagggctgcttcaagtgcgattaggggcggcgtgggaacctagagtgggagagattaagctgaagggaggtcttgtggtaaggtgtgatattgtggggatgttagaagaaacatttgtcgtatagaatgattggtgatggcctggatatggttttggatgaattgagaaactaaatggaagatacaaggtccgaataaaagaaggaaaaaaatgggtattaaaggactaagaattgggaggacccaggacatccaattagagagtgcccaagggggttcagcgtaattacttgcttggttggcaagtttttgggctctatccttgagtttttttatgttgtcatacaccaggccagattgatttaggtaaaaacaacactcctcatttaagaatatgcagagtcctcctttttcagcattgagtaagtcaaggcctcggcggttttggaggacaactgcagctaaagagtcaacttgggcctggaggactgataaagtttgtgatatgtgtgtgatgctagcagagaagtcattagacaggctacagaaggtcatgacagacgttgaaatgcctgctattccagtaccgagagcaatcatggaggcagaaagtcctaaaccgaccatcaagggaattagtggaataactcttttttgtcatgtcggtgtcatgaggggaacagggagctcttcggtcccatttgcaaattgaattttgggggtaaggaagactagtgtacatgtggctgtccaattggcaggtagacacatgtaggtagaggatccacagaggaagaagagaccttgtgcgaggcaaaactggagatgtaaagtaaaaaggtgagaaggagtgctgaaaggggtgtcttgtacccagactcctagggatccacctagggcggcagctgtcagaggttgtaatggggactgatggggtaactgcgtagagggggaggttcgattttcatggtgtatgagaaaacgttgagtatctacgagcaacctttcactgttattttcggggctgggtataagtaaacaagaagagggcctgggaggagagtctgatgagcaaggggaaggtagccaaggatggagtgaaatacagggcacgtgtcttcctaagcaataattactgctaatgtttttaagtttgtcagtattgatagagggcttgtctgtaatatggagctggaaggctccaattgtttcagtgatgtgtgtagttggacttcggagatgaagagtaaaggaacatcgagaaggtgaaaggttacccaggggaattccagtgggtctttgccgagagatacataaaggagcagccacaggaatagtagtttgtgttgtgagaggtccaaatatggggggagtagagttaatataaggagaaaggttttttaaataagtgcgaaggagggcggcagcttgctgatgtgaaatgtctggggaagtcttgctgaacctgtctagaaagtaaatgagttcttcaggagggtaaaggtgagggctgttaaaggaagttcggaggtgtagggagacgggagatgttgcccagtctgtctgtaagacggggacagctgtgtaggcactggaagaaagggaaatgcaaagccagcagttgttcgctaaggagggattagaagcagctaggagagaatgggttaaggttgacagtgtggtggagatagctggggagaggtagagggtgacataagaatgggaatgagaataagagtgagtataaaagtaaagaatagaacttcatcagggtggaagtattggagggtgccttgccagcaaagatcatctatccactttaagagggagttaagagtggcagtttggggatagcaccaagagatatcagctgtgatggcttgaagaaacagtgtaaaccagcagtgtaaacaagagtagggcatttataagtagttgagaatggagaataggagtatgaccggacagaagatagtagggatgactagttttttggggctcggcctaagtggtggggtgacttcgtaaagccctgttgcaaaaagtagggtaaggacgaacagacctaatagaatgaagggatgtattaggctcataagggttattactgttcttcagaaatacgagtgagtttaagggaagtgggggagagtacttgcgacttccaggaggaagaggagggattaggctggctgtccgatggacacagctttattctggaatggtgaacccagtggggaggatcctgcaggcggacggcagtcggggtactatagatgactaagtagggtccggtccattgaggttatagagtttgaggggtcagattcttaacaagaactgatcgtccagctaggttgtcttcatatggctggggatctggagtaggcaagagaagattagcagcctggcgaatttcctgtctagcctgctagagcactggaagatagtagcctagagggctggtgtctgggatgaggttggggccaagcaagaaagtgcgtccatataaaagttcaaatggactgtaccctgtagcatctcggggacaggctctgactctgagaagagcaagaggtaaaagtactgtccaatcctttttaagttggaggctgagcttggtgaggtgtgccttttaaaagaccattagtccgttctacctttcctgaagattgaggacggtaaggggtatgaaggttccactgaataccaagagcctgagaaactgctttggtgatttggctagtaaaggctggtccgttatcagactgtatagaggtgggaaggccaaaccggggaattatgtctgacagaagggaagaaatgaccgtggtggccttctcagacccggtaggaaaggcctctacttattttgagggcctctaacagtattaaagcagcggcagccgctgcacacagacatgagggctaggttaaaacagtaaggtcaagttgtttggacagaaaggctacagggtgtggtcttggctcttgtgtaaaaattctgaccgtgctaaccatgcctaggaaggaaaggagttgttctgtagaaggtgcttgggtttgagagattagtcggacaggattggcagggagagcacgtgtgtttttatgagaattatgccgaaataggtaacagatgaggaagaaatttgggcttgattgaagtaatgggggctgtctgtgaagctttgcagcagtacagcctaggtaatttgctgagcttgatgggtgtcagggtcagtccaagtgaaagtgaagagaggctgggattaagggtgcaaaggaatagtaaagaaggcatgtttgagatctagaacacgataatgggttgtagaggcaggtattgaggataggagagtatatgggtttggcaccacagggtgtataggcaaaacaatttggttgataaggtgcagatcctgaactaacttgtaaggcttgtctggttttaggacaggtaaaatgggggaattgtaaggagagtttataggctttaaaaggccatgctgtagcaggcgggtgataacaggctttaatcctttcaaagcatgctgtgaggtgggatattggcattgagtggggtaagggtgattaggttttaatgagatggtaaggggtgcatgatcggtcaccaaggagggagtagaggtatcttatacttgtgagttaaggtggggggatagaagaggaggatgcaaaggaggctttggattgggaagaagggcggcaatgagatatagctgtagtccaggaatagtcagggaagcagataatttagttaaagtgtctcagcctaataagggaactgggcaggtggggataactaaaaaggagtgcttaaaagagtattgtctaagttggcaccagagttggggagttttaagaggtttagaagcctggccatcaatacccacaacagttatggaggcaagggaaacaggcccttgaaaagagggtaatgtggagtgggtagcctccgtattgattaagaaggggacgggcttaccttccattgtgagagttacccgaagctcggcgtccgtgatggtctagggggcttccgaggcgatcgggcagtgtcagtcttcagcccctaagccgagaagatctgggaaggagtcagagagccttgggccagagttccaggggctctgggagtggctgccaggtgagttgaacagtccgattttcagtggggtcccacacagatgggacgcggcttaggaggaatcccgggctgcgggcattccttggcccagtggccagatttccagcacgtgtagcaagctcctgggggaggaggttctggaggaatgcctggccgctgcggttcaggcgtttggaagttcttgtgtgctggagatgtggctggggtttgtctcacagtggaggcaaggaattgcaacttttttctattatggtacaccttgaaggcgaggttaattaaatcctgttgtggggtttgcgggctggaatttaatttttggagttttatttaatgtcgggagcagattgggtaataaaatgtattttgagaataagacggccttttgaccttttagggtctagggctgtaaagtgtctcagtgttgctgccaaacaagtcatgaactgggctggatttttatatttgatgaaaaacagcctaaacgctatctgatttgggataaagaaaaaggagcattaaccttgactatgcctttagctccagccacctttttaagagtaaattgctgggcaggtgggggagggctagtcacggaacgaaactgtaagccggaccaggtgtgaggaggggaggtgataaaaagattatagggtggaggagcagaggctgaggaagaattgggacctagctcggcctggcgaggaacaacctggggaggaagggagaggtcagatgggtctgtagaaaaggaagattagaaagactcagcgatgcttggggttggtactgaggggacaggcaggagggaaagaaggaagatttgggatgagtttaactggtcacagagactaggaagggactgatgtgtaaaagaatgcctggatgtcaggcacctcaggccatttgcctattttatgacaagaattatttagattttgcaggttggaaaaattcaaagtgccattttctggctatttggaactactgtcgagtttgtattggggtcaagtggcattgcagaagaaaataaggcatttaggttttaggtcaggtgtgagttgaagaggttttaagttcttaaggacacaggctaaaggagaagaaggaggaatggagggtggaaggttgcccatagtgaaggaggcaaaccctgagaaaagagagcatagagacacggaggaggggagtggggttcttgccctccagaaaagcagagagggggttgggacacggaaataagggattggggcacagagataagaggtcagggtgcggaaataagggattggggcacagagataagaggttggggtgcggaaataagcgattgggggtttcttgccccctaggaaagcgggacttgccgctaagggtgaaggagaaggggttgaggggtacttgcccctgccccaggaaagcgggacttggcgctaagggtgaaggaccaaggcaggtgtccctgcgtggtctgacacccttgaaacgtgagtgtataatcagagaggtgtccctgcaatgattaaacaccaagggaaggctgccttcccagtctgtgaccagcgccggagttttgagttcacggataaaacatgtctcttttgtctctaccagaaaatgaaaggaattgaaattaagagaagggagagattgaagtgtggcaccaagattgaaaggagaaagcggttgagggatagtgagggaggttggagaagagagtaaaaaaggccgcttaccggatttgaaattggtgagatgtttcttgggctggtcggtctgaggacctgaggtcgtaggtggatctttctcacagagcaaagagcaggaggacaggggattgatctcccaagggaggtcccccgatccgagtcacagcaccaaatttcatgcgcgtccgtgtgaagagaccaccaaacaggctttgtgtgagcaataaagctgtttatttcacctgggtgcaggtgggctgagtccgaaaagagagtcagcgaagggagataagggtggggccgttttataggatttgggtaggtaaaggaaaattacagtcaaagggggtttgttctctggcaggtaggagtgggggttgcaaggtgctcagtgggggtgctttttgagccaggatgagccaggagaaggactttcacgaggtaatgtcatcagttaaggcaaggactggccatttacacttcttttgtggtggaatgtcatcagttaaggtggggcaggacatattcacttcttttgtgattctttagttacttcaggccatctgggcgtatacgtgcaggtcacaggggatgcgatggcttggcttgggctcagaggcctgacacaggacttgtgggaatataatccatggctgtttgactactctgaactgttatactgctgtttttctgcccagggggatgttaaagccaaaagcaagtaatcaacaagattttttttaatcttaaaatactgaattaagccttaacctttaaaacaatttttgttgtagacatagatttgctatttgtttcagacatcctttaggcttttgatctagcacatgactaccccttcttaccgcattgcccctggatcccccaaggagagacacatggctacctcctttgtaccttggcccttgctgtactgatcacagctagttaggacagctatgaaagcctgctccatgcagaactgattctgttcgcatgagaatttggaattggaatttagagctaaccagttggtctgtgtttgtcctgaacataacataaaaattaattgaaatgagagacagagagaggtgtattgttgtgggggcgggtgagaaagtagggtgagggaagggaaggagggaatgctgaagtatagagcagagagcagcagagaggtgagaaacaggaaaacattcctcaaagcttctccactcccagtccaggaatcttgcctagccttgagttacagaacacactgttatctctggataatacatttcctattttgctcaaagtcctggtgtgaatatgcaaccagagatttttaacgtaaaaagaagctatgagcatatgaatggaagttgaagacctgagaatggactaagggactcagggttagggacagaccctaggaggaaagatggcattcagagatagatagttaaaaaacaatcaagaaaaagtagccagataagtaggtgaagaactgcttgacaatcaaggaaagattggtgaattaggtaatattcatttgcataaaatgttgcccagtggtcaggtaggcgaaaagctgaatataggcagttagattttaccatttttatgtttctatcccctgctacctgactaaactattttcaaaatgtattttatagcttagagccttcccaaaattcctagtattatatataaatttccaatacatattgatagctgaacaatcatattttcctggggtttattttaataatatatgcatttattttagccaatgatattcacaaagctttgctgaaatgtgttttgtttaacttggttctgtatatttttccatgaaaagccatactaaaaggacattttccaagtattaaaaaaaaaagcaaaaaaccctgcagtccagaatgcataatttgttctgggatagttaaaattctaagagaagtcttctttgttctttccttgctctttctttgttctccaaaagggtcgtatttaaactatgggtcatttctcatctgaatagccagggaagattagctacattgctactgatgcacttgatattttctcattacataacatgtggccacagattctagccagtctgataagataaaatgttcataatacttagaagataaaagggaatcatcactacttaagatccctttaaatccaatctgttgatctgtatgagattacatttttggctctcatttactagttccccctaaagaaagtcttgatatagctactgggttcctggcttgtattttgatagtcaaaacggcagtctggatatttttctactcagtagatacaatagaagaccaaagcttcttgcattgtagtcactgaccttgccatgtcatttcatattttctgtagatttggtcctggaaaatcaaatattaagcaagtttgacagttcagctaaattccataaggtcatctatcacattacatacagtaattgattttacgttaattggtctttagtttcatggttcatgtttctggttttctggtagtttccagaaactttcgtgttaaatgaagagctatgctatgtaaataaaattcagtaaaacttccctttcattttaattatgtgcttttgaaaactaattttattgggttctttaaaaaactccgtaggagtcaggcatgaattttctactctttagggcatttcaatcatgaaagaaagaaccatctatatttttcatcatctcaaaacaattttagaccactactatttgtaggtacaaataatgttcattgatttgctttatatttattaatcacctaatagttatgaaatggtgccctaagtactgtgactaaaaaataaatattagtaagttaattttactaatttttatccttaggagctttaatttatgctagataatatctgagaaaaagtcaatagtatgatgctgtttaaagaaagaaagcaactgctatcctgtgttgttgtattagcagaattgtcaaggataaaataaataaggtgaagattagactccacttggcaatctttagcccttgattggagtaccatgttccatttgggaaggcacacttattacaacatagacaagtttggcagaggtttcaaaagaaagcaacaaaaaaatgatgaagggccttgaaaatggggcctgtaagaaaaggctgagagacgtgagaatgttcaatcttgaggaaaaaaggcagaggggacacatgataactgtttacagatgcgtaaagaggtgttatggagagaagagggacctatttttctcattagtcaacaaagacacttcaagaagtaatgggtttaaaacacgtggggggaaattcaggttaattattagattaagttaggtaaaatttaaatatttaaaatgttatgattccaagcataattaggctgtggagactaaatcacattagaattggcataggaaagtgagatgaaaacaaattcaatctgaatgcagagggttaattattgcaagtttatatttgcattaaatgttatcatatttcaaaatactttcacatatattgttttactgatctctggacattcttaggaaagagagagtgtatcagctagttttacagctgagaaaatggaatttcagagaggcaaaatgttgcttcgaacccccacactccagattagatagacaaaactgctaagtgcataggattagacaagcaggactaaaagccaactcttcacattttctgtcaatatgtttcacatggtaccttgctatcttttcatttgtaatatgatttctattgtggagaaatattgtttacatagaggaacaagaaacatgattgaacttatatctgcattacctatatctattatttatctctcactactcacaattgtgaaataaactcagcactttggtattatattttgacaaatcattgccaaacgtaatacaatctccagttggtatgatgtggtgagaccctaccttctaccattacctagaggtggagacacatttcatcttttatgaatttcatattcctcatctgtaggaagaaaattataatatcttctggtttcttctagttttacaataaggagtgaatgagaaaatacctgtagaagtacctgaacttgttcaaagaaataaacttgttcaaagcataaactttgcttggggggaaatgtgtgttgtttttggtgtactgtggattttgataatccctttccagttttattttcaatcctaccttttttttttttttcatttcctaatttcagattcctgaggtcaaggccaatgtctttgttgaagcacttaaaatttgctagtctaatgtaggtgttcagtaatagttggtgggtgactgagttaacaaatggatgaataaatactttcagttggatattatgtctgggatatgagcaagaggtgataaatgccatatataatcatcttgttatactcctttatgtaatgatgtatgtttaaagtattttatagaaacatggtatgccagattctcagttagatcctgagaatacaagccactcaaagtctaaaggggttttgcagaccactccaatgctaggtatagacaaaactcttcccagcaaagcaaggtagctgatgccaaaatgttaccaaggaaagacccattggttggttgccaagacccttatggagtctgagaagatgttttagactccctcaaccatgcacacaaattgtgtaaagtaatccaggaggcagcctaaatggaaaggctgttagtatgctgagcttgctaggaaatggaggaattttacggaaaatgtcagcctctgtagactcctgtgatgctcgctagggtgccagccttccccagggagcccacagcacctggcaggcagactgcagcagggagtctcactgggaggatacaaaagagcttaatggccccctgtgcataatgttgaaagaggctgcaatttttgttttcttcggagattaacgtgtgtgtattgcaggttcaaaatggtaagaatcttaattagagttgcaggaagttgcataatatactccatgtcttactttttccgcacaccaaataacagaatctatttgccaaattatgaaggttgatggagaatgaaaactgtaatttgagtaaatgggagccctgcccccattttttccagttagtcacaaagtttaaaatgcaaagaagtaaatctcccaagggagcaattctatttcatctgtggaagaaagacatatgttgttactgatgaaacctctgttgtgaaagcagagccaatgctgggaaaaacttgaaggaaaaactagctgagagccctctgtctcaggagcctgtggcctttgggtccacccagggctgcctgtgcctcttcctgaggcttttcttgaaggcctgctctttcctctgattaccttagggcaattgcctgcctctcttaagagaaaatgtacctgttttgtgccacatcccttcaggcccctgagctggacagtagattgatctgacagatgtcactttgatattaaatcaatagtaccaatatgtttctgggttttcctggccttagcaaggttttatgttcacttacttagagacattctggagaatatctcagaactcaaaacatgagatcaaattggagttctatgggagagaggatattgaattacttggctttattatggctgcactcatagggccagccacgtgtaaaagtttcattctctttttttgaacaaatatttattgaaaacaataaattaccaagaactgtgttaaaatatacagatgtctaagcagacacggcacaatctatggccctaagaagtctaggaggtacaatattttatataaattattcatcttcattcaaagttatttattgagcatctactatgtgccgtgcactgtgcatgcccctggaaagcataagagacaaaattcctttctttgtgggagctgtattctagtgaggttcagcaggtgaacagcaatccgtgttaattatttcttcttccactgaaatgaaaattctatgtttctaaaaaatattataaaagtactcttcaaacctcatattaagaaagtcaaattgtctttagccacatttgataaggattaaagataatcttactattttattttaaacatatttagagcagtccttgtctgaaggaagcttgtgttgaattttttataaagtgagttaattaccttctaattaattttgtgtgtgtgtagtgctcacctaacacaagattttcatgctgaatttgctcccccaaaagaaaaacaattcctatatatgttgtaaagggtcgcaagtcagaactgagatggaggcaatacaaatatataaccagcggcctcagacaagttcccaaaattgggaagaatgaagagatagggaatgactgcagagcctttttcaggaaagcatgagattggaagatgaatgctcaagtaaattagaactcaggaaaagtactgaacagcaggatcatatcatcaaaaatctggctgataggttttgaactcactgaactgaatctatttagaagtacattttgggaagactaaataaacatcaacactatggtctattctaattcaggctcttgctttgtctattttccaggtgataaaacactgattgttattagtgttatcatcaagcatattgagcagtcaatctgtaagttaatagcaatacacagccatatagtcctggaactagaaggaaagaaaatgaattttttcttttttttttttctttttttttctgtagaggggaagaaaaattcaacaccttgagtcagctgcgactcaagggtccattataacttcgagatttttaacagcctgtgcctagggtatgggagatgaattttgttccaaagtggtgacatgggcagatataaacccctgggagcaatttcaggcaagttgagagtccattctaaacaaaaatggacagaatgtggaagatggaattcccacacttgctttctgaccttggctgatattcctcagcagttggtaattagaggaaatactgaagctgagaggatgaaagaataaagaagagtagaataatcagaattgaaagaatgtaaataagtaataagatggggcaaaaacaggaatggtgtcactgacaaaggtggccacactttgcagtaagatgtgagtgggacatagaaactagatttggttgagtaagaggaaaaccatatatacacacacatatatatacacacacacacacacacacacacattaatatatgcatatttaaaaatatatacatttcaaaagctcatttatgttgaatactaagtgggaaattcatcagctgtttggcttcctgtctgttttattctttgccattgcagacttgagttgtcttcctgaaatctttctgggagataactgcatgcccagcccttttctttcatcagaaaaagggtattctgccctgagtcagaagcagggggaaaatagatgataatatctacatgttattgctagaacagagtcaaataaaaattaaaagtccatcaagtgatcaggttgaagtcaataaaaaggtcaataaaaagcaaggatgagccaaaaaagaggacttggtgtactggaaaatgccaggaaaaataaaagacagaaaaaacactgtggcaagatcttctcctgtggcctcagggaagtgcatgataaaattaattgaagcttatcacccatgaaaaagggctacagttggagcaatagctgcacggactacataacagtacaggttctttagcctaagacaaagataacagatttttgttttacttttgcaagcttttttaatatactgagttaaaactctctttttttgcctttattcaactgaatgctgcattttttgagcaatactaagtgttgattggcttacttgaacagcaatttgttaagaggcctgctgtgtaccggccattatcctaaataccagtgtacaaagattagtgatgtgtctatctgctttcaaaactcttataatctgtagcaacatgagattaatttttacatatggtttatatataacaatctaattccaatacaatcatatcattctccatatctcataagaaattgttttgggacattatttaaagaaaactttatacaataaatctataaattgttagtagatttgactcctcctttagatgaaagttttcatcttgtcgtttttttaaattcaaaatatgttattttaagttgatataaaacaatcatattagcaaaatgcatccacattgaaaacttagctggatgggtaaagatcgctctattaaactgtgatgtttaatactgagtgtcaacttgattggatttaaggatacaaagtactgatcctgggtgtgtctgtgagggtgttgccaaaggagattaatatttgagtcagtgggctgagaaagccagaccgacccttaatctgggtgggcacaatcaaatcagctgccggtttggctagaatataagcaggcagaaaaaggtgaaaagagagactggcctagcctcccagcctgcatctttctcctgggctggatgctttctgcccttgaatattggactccaagttcttcagttttgggacttggactggctctccttgctcctcggtctgcaggcggcctgttgggaaccctgtgatcatgagttaataaactcttttacatgatattctcatgatagtgaataaatttcatgagatctgatgggtttatcacgggtttctgcttttgcttcctcctcatttttcacttgctgccaccacgtaagaagtgcctttcacctcccaccatgattctgaggcctccccagccatgtagtactgtaagtccaattaaatctctttttattcccagttttgggtatgtctttatcagcagcgtgaaaacaaactaatacaggcactgttccatctccaaatggtcataatttatcagttcaaaggaacgtactttgcatgccaccaaagggttttctaagaattgggtcagcaattttaagtcaaggttgttggttctgagttgtacctttgagtcagtctttcagcattttagttctcaaatctagttttctactctttccaatggggttattcatccaatagacatgggaaaatcatcctaatcaaaacaaatttatgatcatttctctctggcatgactgcatcaggtagcttaaaccatagaagtttattgtctcacaattctgaaggctagaagttcgagaaaaagatatcagcaggattgatatcttctgaggggctgtgaggaagaatctgttccatggttcacccagcttctggtggtttgctggcaatctttgatgttccttttgcagtgtcaccccattctctgccttcgttgtcacatggcattttctttgcatgcacatctgtctcttcatatggtgtttcttttataaagacaccagtcatactacagtagggcctcaccctaccccattgtgacttcattttaatttattacatctgcaaaatccctatttccaaataaggtcatattctgaggtatgagtgggttggactacagcatatgaattttggggagacataattcaatccattataatcatactgcataactgacgagaaagtaaagaatcaatctgatgcaggaaagataacctaatcaaaaagaggaattaaacaactccaactaattccttacatttaatctatttaatataaaattataattttgcaaacacagcatggtgcactatggtaactaaagcaattggatgatatttcaaaagctttaataactagtatttaatcacagatgctgtgtgtttttacctgaaattcatcctggtaatgcaacataattaattgcacaatttattttagcatgagttttcttatatttatagagatagcatagcaatcttgttttcaaatttccctcagaatgcttgagatcagacattattagcatggagacaatagtttcattgtcaactcctgctggtttgggtacatttacagtaataaccacaatccactagcttgaattattgttcaacattctatgtgacttcatgagggtattaatatgcaagagagttatttgatactaatcaaagatacacatttgtcttcacacttattacaatatggtaaggtaatcacataaaatacttaagatggtagacttcatacatatatatatatatacttttaatgaatatactaaagctaaccgttaatggaagctttgacagaaactcattgttcaatatccaagcaaatcaattttggactataaatgcagaattctaacaagcaaaaattctaatcattcattttatttttctgttattcgtggcttcttatattgttaaggcttaacatattaagatgcacataggatttaatcttcatgagagagcaatgaatacatcattgaatacataccaatcatgtgtaattgttttcatatgtatgtaagcccagcggaaaagagtcgttcattgacagtactcattttcccatttggtgtattttcctaattgtacagtataacagttatagtaaatggttataaatattaccctttagctgtaacatctatgacatttttgttgatcatgataatatgtgattgtttagtcaactgagtttattgtaattgagattggaaatcactataagagtgaaattgaatatatagatagagaaataggataagttaatatggcagctcaacactgaacacagactacaacttcttgaccaccgaaatatgcaaaatattatataatagcttgtatctggacagcgtgctaagctgttcacttgttctttatcatttaatcctcttttcaaatatgtgagatatgttctgagaagataagcaccttgttgagtcatacaggtaatacattttaaaggaggaatttatatacacttaagattgtgtgtgtgtgtgtgtgtgtgtgtatgtgtgtgtgtgagagagagagagagagagagagagagagagagtttcaggctccaagacagatattaatggtagactgcctttgttgcataactgtagcagtggtgtacaactgctactcccatcttctcagtacttcatctctttctttgaatcaactacagctattctgatggctagattatgatctgccagtttgagaatccaactcttgctggccagagacttacagttaaaaaataaatcatttagagtcatatgcttatgtactactgggctgtgatcctcaccctaaagctcactttggcatagctctttacttgccatcgattcttgacagccttatttcagaattcttacagacacagtgtctatttaattttaatacaatcaagcaatggtttctggacatatttggctatttctttgaaaacaatggaatctgtcttatgggcaaaatgacttttttctgccctaaatgctgacactgaattgcgttcaatcatgacagaatttgtgcaatatgaaaagtttgtccactgggtggacaatttctatctagcatttttctctccttcagggatggactttaagttgatttgacaaaattggtttcatatgaacccaaatgcaaaccctatattatctttaaacactggtttctgtgaagttgtttgattaaactaatactgttgactccctgttttctgttttatttctttaagatgacatcccttattctgttctgctacctgggacattgctcttctctccatattaattaattaatattgtttcctaaatctgtcttcctagtctctgtgtttgtcttcaccatgtgtattgggatatattctcgaagggtttcatgtgtgaattccctcttgagtcaaattgtacatgtaatttcccttcattttaaaaataaataagaaatatgagaagaattttcaaaacttttatgttctatatgctttcctctggtttggaaattaatctctgaatttatttatattttaggtattgcaatttgagaattagaagagttgtttttacaaaacacagaaaacagcttttgttttaattatttttcccagtgtgtctaagagtcaaaaagactctgtattagtattcactggcaaacagaacacaatgcagagcagatatcctagaagcaacatgatagatccaatcatccgattcattatagtacaaatattgtaatcaatcataatattcagtgttccataaatccacaattctgtgaaagggataagaaaaaagaaattaagctatcagtgagtttactaaaaaaggaaaagagatttcctgattatcatcattcagaattagtcagacatatacatggtaatcattcatattttaagcaataaaaggaaactcaacacaaagcctggaaagcaacagccttttatttttattttctctaagatgtgaaaaaatagacctaggtgctaatttaattcccttttaagttaatgacataatgggtttgtggagcattaaatagggaataaatatggccttacatttccatgtcggagctaaatgctttctcttccctcagcttctaattcctcagctgagggaagtgatcagcagtcaacgatcacaatgagggagctacgcacacatcctctggtttcctgagctttggaacacttaatgcttagtgcagcttctctattttgagttctaccatgaacccctctctgatgactcccacatatgtcttttttatgtaagcacaccaagttcagctatccctgtaggtagacagcatttgagacttctcagttgggtatgatttgagaagataatggagctgatcctcttgacataaactagcctattggtcctgcccaaactggtgttccctggaacagaggcctaaaaacaaaatatatttaaaatgttcaaatatatttagaaaatattgtgttaaatcaagttagccagatttttgttgctttcattgtcatttttgttaatattgttgcatgatttccagaatattcagtatgcaaataaatattcattatgaatttaacaaaataggtattttctaaacttctttgaccttggaactcttgttctcccttcccaaccccaccattgcacttattttaacattgcactcagcagggctatacgcatcaacattttgggaatttgaggatgaagatatgtttttcctattaaaaatgaattcttatcccactgggaaagaaaacacattaagcttttatcagtctttaacattttaacatggattagccattctgctctttctggattataagcagctgagagcaggctttcattatagggagagggaaagatgatctgaagtgtcatgtgtccccagagaggattttcaagtggaatgccaccatgagagttcctgggctagcagaggacaacttcatatagtgcagggttgcagcaaggccactgacaccagctgtatatagaaagttatgtttgcctcagtttcttcagccaaaacagaggaaatttactagatagtagctatctccctcttagctctaacaatacaatctgattatcttgatggctaagtgtgggaactgagagagttagaagagtgggggtcactagttgaaaaagcaaggttagaaatgaatgttttctcagtcatggctggcctagggctggctctgcaggagttcatgattctcatctccccaaacaacaaagagccatggaaaattcatcagataacagtaattcaacagataacagtataaagactatacatatttttaagatagatttaaaaaatgcatgacatatttctggcctccaatgagtgttcagtatgaaaaaataccaactagatgaataagtataggcaagcaaaagattctaagtataagaaagtgtgaaaagtaaaatttattttatttttctttgaaagagcagtcttcccaggtcaagagattagaaagacaagtaaggtaatgcctcttctctgaagtttagaacagatgaaagtgacacataaaagcagaataagataaatattatatcatagtaaaaggaatgagaggttgtatgtagagtggttgtggacttggactcaagagcatgtggacacaaatttctaggttaaattccctggattcagaacccatttctaccatcttactaggtctgtgtcctcttgtgtaaatggtagtggtgatgataattaccatgcctttctgctagaactattattaggaggattaaagaaaattaatatgtataaagcatctagaagagtgcctcacataaaataacaaacataagtatttactatcattaataataaattatatccaactagaatcattataaggggttttagaaaagaagtagcaataagataataagtgaagaatgagtaaatttttgaagctacaaatggattgaacatagtactctagggagagggacaatcatgaatgaatacatcaagatgaaaagtcaaagggtaaattttagaaatagcaaatagattggtttgctaatataacatactggccctttactgatcatgttgatcattttgtgagaaaacagtaggaaatgacttcagaaagaatatagtttggtaaaaaccattttaactgtaggagaatgaaactggattctcatctctcaccttatacaaatatcaactcaagatggatcaaggacttaaatcaaagatctgaactaaaaattctagaagataacattggaaaaacccttctaggcattggtttaggcaaggatttcatgaccaagagctcagaagcaaatgcagtaaaaacaaagataaatagatggaacttaaccaaactaaagagcttttgcacagcaaaaggaatagccagcagaacaaacagaaaacccacagagtgggataaaatcttcaaaatctatccatctgacaaaggactaatatccagaacctacaacaaagtcaaacaaattagcaagaaaaaaatgaacaatcccatcaaaaagtgggctaaggacataaatagacagatctcaaaagaggatatacagtggccaacagacatattaaaaacatgctcaacatcgctaatgatagagaaatgcaaatcaaaaccacgacacagtaccaccttactcctgcaagaatggccataatcaaaaaaataaaaaaataatagatgttgaagtcgatgaggtgaacagggagcatttcttcaccgctagtgagaatgtaaactagtacaaccactatggaaaacagtgtggagattccttacagaactaaaactaccattagatccaggaatctcactcctgggcatctacccagaggaaaagaagttattatatgaaaaagatacttgcacacacatgtttatagcggcacaaatcacaattgcaaaaatatggaatcaacccaaatgcccttcaatcaatgtgtggaaaaagaaaccactgtatatatatatacgtgatatatattgcatatatatatgtgtgtatatgtatagtatagatatatgtatatatatagtatatatacacatgatatataatgtgtattatatattatatattatatataatatatataaatatatattttatatatataaatatatatgatggaatactactcagccatacaaaggaattagttaatagcattcacagtgacctggatgagattggagattattatcctaagtgaagcaactcaggaatggaaaaccaaacatcatatatgctcactcaaaagtgggagctaagttatgataatgcaaaggcataagaataacacaatggactttggtgactcagggggaaagggtgggaaggcagtgagggataaaagactacaaatagggtacagtttatactgcttgggtgatgggtgcaccaaaatttcacaaatcaccactaaagaacttactcatgtaaccaaacaccacctgtgcccagtaacccgtggaaataaaaaataaaagaaatttttgcccaaaccaatgtcctggagtgtttctccagtgttttcttctagtagtttcatactttctggtcttacatttgagtctttaacctatttaaatttgatttttgtttatggcaagagatagcattctagttttattcttctgcatatgtatatccagttttcccagcatcatttattaatgagactgtattctccctaaggtatgttgttcacacttttgtcaaaactgcattggctgtaaatatgcagatttatttctgggttctttattctgttcttttggtctatgtgtctgtttttatgccagtaccatgttgttttggttactatagctgtgtagtataatttgaagtcaggtaatgtgatgcttccagctttgttattttttgctcaggatgtcttggactgttctaggtctttcgtggttccatatacattttaggattttttttcgatttttataaagaacttcattagtatttcgatagggattgcattgaatctataaattactttgggtagtatggacattttagcagttactgattcttttaatacatgaacatagaaaatgtttttatttttcatatctttttcaatttctttcatcaatgttgtattgtttttattttagagatttttcacttctttagtttattccaggtattttattttatttgtggcgattacaaatgggattactttaattatttctttttcagattgtttgctgttagcatacagaaatgctactgatttgagggaaactcttctacactgttggtgggaatgcaaattagtatagccgctacgaagaacagtgcagaagttccttaaaaaagcaaaaacagaatggccatatgacccagcaatcccactgctgggtatttatccaaaagaaaaacatcagtatatcaaagagatatttacactctcatgtttatttcaacactagtcataatagccaagatatggagtcaaactaagtgtccatcaatggatgaatgaataaagaaaatgtggtacatattcatgatgaaatattcagccattaaaaaagaataaaatccagtcgtttgcagcagcttggatagaactgaaggacattatgttaagtgaaataagctaggcacagaaagacacatattgcatgttctccctcataggtgagaactaaaaaaattgatctcatggagacagagagtataatgatagttatcagagcctggggaaggaaatggggagggggataaagaagtgttcggtaatgggtaatgggaacggaagtacaattagatagaaggaataggatctaatgtttggtaacaaaatagtgtgactataattaacaataatttattgtatatttgaaaataactagaagagtggaattggagtgttcccaacacaaagaaatgatgcttgcttggggtgatgcatatcccaattatcctgatttgatcattatacattgtatgcatttgtcaaaatttcacgtgtggcccataaatatctacaactattaagtaaccatgaaaattaaaaattttacaatttaagaaaagttaacttgacgagaaaaagaatacagtttggaagtcttcgaggatagataggaagagattttccatttaatttggttttaaatgggatcttgtctatgtttgctcagggtaatcatatgaaaggcattataatttgaaagcttaatctcaaaatagtactttttttggtaaccagttgtcttgcagcaaaaacaaaagcactgaacttgggtcaaaatacgtgaattcaaatccatactttataccttcagaatcaaacactctaagcctcattgcgttactctttaaaataaggaaagtgcatctaaattacacattgtttttagtagcaaataagttagatgaaaaagcatcaaatgtaatgttgggcatacataaattttcaatcaacttttaactatataatattatctgaacaagacaagtgaagaatacaattgtaattttttaaattgcaaggcaacagtttctaccctaataatatctacattttcctcataaaagtcagtgcatcagattctatacagtatgctcttcaaattcttggctccaaagttagcaaattaaacatcccatctcatttctagtttgcagtgaaattctcaaaaagtttccagaatccctgatgttactcatcctgagctacatctgacttctaatcagcatcttttacttagaatacagatagcaaatctggttggcagttattttccaatgattcttctgccatactgatgctttataatggctccaaggaaaggccattctacaaataaaagcaaaattaataaaagaatgcgggataattgacagttttgctacaacagcatttaatttgaatcctttgaaacttactcttcactcattgatttttaggctcacaaattctttgtgtgaattctctcttttacttttgcattgtgaaatgatttatcatttgggtaattttccagaattacactttattattttgtaaatggcatgcagcacagatggatattagcaaggtctctgtataaacgccagcaatagaggtggtaacattgccctgagagttttctcctgaaacaaatcaaataaagaagagaaagcattgccaaagctggccatgacagaggaagtggatccaataatagacatctcgatggatacatatatatgattcaatattgtgtgacctttactttcaaactcactttcagaaaatatattctaaaggggtgccaaggatattgctgtctactctctactgacttccatgaaaggaaacaccattcctctgtatctcagtcatcaatgagtacatttatgaaagagtttggccattgtcaattctaatgccgttaagaagaacttgagcatagcttacatttttttcctcattttactcctacttgtatattgctttggcatatactattagtgcaatgctgtgacttccaaaacttctcagaaagtaacaacttggactgttaagagactccagcatttgaaatatattttaatgcaaactgtctccctgaagacctctatccatagctaagatagttgtatccgaaagctttgcgcttacttctttgcagtgctatttgtaaacattggcatagtaagagtgataaatttctatggaatcatctttatcaaacatacattatagaagtagaacttattccagctaaccacattatcatgaatagcattttccatatttctttgaaacaatacaatagaaacaatattatcttaaacattaagtatccccattgattggtccagtgaaatactgcttggaatgaaggcttcaactttaaatctatttaatcaaatttggtaaaacaatcatggatcaaatatattattaatgttacgtggcttttattattattattattattgcaaaaattaggagccttggtttttgtggccttattctatttcagttagatataatatctcctggccttgggtgctttttacatacaaatggggtaaaatagttattataaagaatagagattgaatagatgtgcttagagtaatgtctgacacaaagcaagcactcggcccagcacagtggctcatgcctgtaatcccagcactttgggaggccaaggcaggcagatcacgaggtcaggagttcaagaccagcctggccagcatggtgaaatgctgtctctactaaaaatacaaaaaattagccaggcatagtgccatgcacctgtaatcccagttacccgggaggctgatacaggaaaattgcttgaacttgggaggtggaggtagcactgagctgagatcccgccattgcactccaacctgggtgacagagcaagacctcatctcaaaaaaaacaaaaacaaaacaacaacaacaaaaaaagcaacggctgttaattgccaggaagaagagctcctacaattgtttcatgtgcatttaggcactctcttccatgtgagaccccaagcagtcagcaggactatcaaaggaacccttttaagacttagatatctatttttaattcttgcactgcatttctactttgataaggggaaaaggcattaaaacacatttttgaaatgtaaatttccaaagttacaaaaattaacccaacacatcatatgctctttgaatcacttaaattggcagctgtcttataatgataaaagacctacggcgttcttagatgatgtctacatgatgccagacagctaattgaattaaggaattaaggaagatatcaactagtccttccccttatttgccagatgaagaaatggaggccaagaaatgtgtagtgatttatttacatcaggggttgagtctgttggtcgtgagaacttctagcctagttattttttccaccccatctatctgtcctgaaatttggtttcttattgctgcagcattgaagagatggaaccactaaaaaaatactgataaaaagatgtttatccagaggcaactttaatggcaactcaaactatttgaaatatgatggaaaatttgttactgagtgaaaaggccatcgcacaatcaaaattgatgtttaaagctcgcctactaactcttccacactatccaatgtagtggtcctccttcattttgctctttagagtttccctaattttctttatgcatgcatctgatttcatcttactttagagaaaatactaacagtgtatgtctagaacatggcagattggagccttatagcacgagaggcagggaaaagacagctaatagcgattcactgataggagaagaaggggtcccatattgtttgagttttagataacgtttaatgatcttcctggataacagattctatgaggattttttttttttgcttgtttaaataaaagctgattcaatgataacaaaaggagagacagtaacttcagaaaaatatagatatgctaattcttacatttgtagagcccttttgatattaaggttcaagatctaaaaatgtaattctcattcaagaccgtataaaaattgttagttctatataagcatattgaatcactgatagattaaagcacattcatcatactctagaaaacaaggaaatgtgtaatatatttgatgtcatttttattacaattgttaaaatagtgaagaataaacctgttaactagaaatctatgcatgcagaatgtcttattacctaaataacaccagataaatgaggtgttactgtccacagtctcacaacagagacatgaaaaacccttctttacactggtaacccttaattaaactgaatttttggtgtgtcccttcaggagaaggtcaccatatcagcaataattaggggaaatggcattgtgaacattactggatgagatgtggtgtatttcttactttcaattattgcctccttgtttgaatcattagcatttggcagatttgttgctgaatttgttgttctgatttaaaactcggtgtaaggttgaatatgttcttatcttgatcttatatttctgccatgacttgcatttcttgctgagtttctgacttgaattgctctatgtttttgctgagcttttgctttgtcttgttgtatttctatctggaggggtttccctccgcctttttctttttgttatatctcttctttggcctattgtatttctctggcccattcattagctttttttttcctttaaagttattctcttgttcagtatatgcagtacctaatcaatacgcttccttgcttgctgcaggatttccaacttactgtgttttctgtcagctttgatactgcctgagaggggtttctgtgctttggctaatatattgttgtctgaattcgcagtgttttcagctcattacactgactttaattttgatgtatttgtattttatccagttcaagtcatgtttctttcctctgtcaatttaattactttctgcctgggcaacattgtgtttatacaattgctgctaaagcgacaaaaggtttctatttaaattaccacccagagcatcagcaattcagcctaaaaaatatgcagaactcctctgattgatgtcttacctttctgtggataaggaaatctagtctattgagaggatcttctttatagaacatagtcaagcctggtttatagctgtagagtcattaacagaggagatgagtgtagggctatggggtcactgtatgacttctctgtaagaaaaaaatgtatgactaggttctattcagtacaagtcatgtcctaacagcaggaaaaagaaaactttcttaggtgtttaacttatatttaggtgggctacccaagctccagctcttatttttctatgtgttatatatattatacacatttctgggtttgaatcttgttctttctaataattttgcattgggctgtgtaagtcaggaacattgaatttccattgtgtacataaaactatagcaactggtctaaaaacaaataatgtgggaaacatagtaactgttcctgttttcaaaggcttacaataatgcgaaaaaaagggaaaagcttatgagcaatacatctttgaaaacagaaacagtgaaaacactccagtaaatacataattggttattaatagaattttaaattggagaggcataacaattgcaacagctcttggaaatgcttaggaaactgaggcttataggtttacccgaacatatgtcatagataacattaatcaactagctgatgaacatgaccagcaaatgcattgattgcctgatcagcaaatgcttcaactgttttgttttacaagacttaatatgtttaaacaacaacttactctttacctactttttaaaaatatccttctgtattttctgcaacaaaccattgttgagtccctgtgcttaacaaaactgtgcaactgtgctatttacccagaggaagaagaaagatttttttaagtcagttcttttctggtaagtgtaacttttctagtattggataatctttctgagcctcagttttcttatctgtataattggcataaatgaaccatgagaaacaaataaaatgacatattcagctcagtgtgtgtcacatggtgagagacccattaagtttgctcttttccttttgcctttctcttttcagtgttcagtcattatactgtcaaataaattggagtttctggcttttctcacactcaagattattatgatatactacactagtacatctgaccttgataaaaagcaattttctatagtttaattgtatagcaataggatgggaaagtctctgattctcactctgtagcttcttcttcccagggctggagtcatttaatctctacctttaggctcattctaccctggtcccttgggtcatgaattcatctggaagattcagacttatgctttaaggctctcagaaactcaatcttgcagaagaatctggcctccattttgtacacactttgttcaaagagcctcctagcaccttcccaagacccacatataccactcccattttctctcttggttctggtgattgactctctttatgttcttggaaagctgcctagtatcctaaaaccagtattgctgcctggctgttaccaggctgcaccctcgactaaagttgatcccctgcactcatctttggactctagatttctattacatgcacatcccttgtgccaaattatgctggcttgtctggccttccaagtttcacctattgttatgcttatttgtcagttcaagtctctattccagctctatcccacttccttctttctttagcctgtgtccctctcttggatccctgaaacattttgagtactagctactcctatgtcctgcccatgtgattaagaatgatacttttctcccgtgcttgcagctgggtagtcatactccatacccacccaggtaaaaatgtctggatccaaatctacctttcataacagatctgatgtgctattctagacagctttactccatgatatattgcagactttatgtaggttaacaaagcattatggtgtcattcttgtgacagccctacattttcattatgatttttgtgtttgcggtcctttttgtgacaatttcttttagatgaaaatgcttttaatgaagcccttttggtacttgggagcctcactggaatggatttagtacaaacttgccttatttcaaatttatgttcaatattgaacaacactgttacccatatttaggacagtagacaggtaaaggttgcagaatttttatgaaatataaagcaatatccactgttataatgaagcactacataaaattgtataatacgtgagtttcttattcctcaaatagtctaactgattgttcattgggctcactcagccaaaagtagagggaaactttgtacagacatcattagtttttctccatttagagattaatcatgaagagctctggctctttaattctgtaatttgtatatttaatgggctgctgcagaatctatgacagtaattagcatagcctgaaaactcattaatacgcaacaacatgattaatgcagcattaatgcaaacatgactgaagttatttgggttatgtagtaagaagattaaagctaaaatgtcctgtttgttttaccagtggtgagtataatagagtggcaaaaaaataaaataaaaacaggtatcaaattagctgtttaaaaaaaagaaaaaaaccagcaaaatttaaatcaaggtgattttatttttcccttaggtctaaaatttgggatataagttatgttctttacttttatatttattcatttattcataaatttatcattactgaaggaaagttcattcaaccttttagtttaacatagttaaccttttagcagctttaacataatattattagtcttacattggaaacaattttaaattgtactaatctttgaccaatacattacacatttctgttttgaaactaatatatattattggctatgccaaataattaaaggatttgttcctacttattcagaagttacatattatgccctcttctcactgtgttcacctcttaaataaatgttcaaatactttataaaatactaccataaaactcatttttttaaacaaaactatcaaatatgacatgttaaatactgaaataatcaataatgtttggggatgtaaaagtatataagttttgcttgttcttgctgtctcatgtaatcatattgaagtcctctcattcttacttttttttggcttttcttttttgagacggagtctcactgtgtcgcccagactgcagtgcagtggcgccatctcggctcactgcaatctccacctcccgggttcaagcgattctcctgctcagcttcctgagtagttgggactacaggtgcccgccaccatgcccggctaatttttgtatttttagtggagacgaggccgggtgcggtggctcgcccttgtggtcctagcactttgggaggccgaggcgggtggatcatgaggtcaggagttcgagaccagcctggccaagatggtgaaaccccgtctctgctaacaatgcaagagattagctgggcgctgtggcgggagcctgtagtcccagctactcgggaggctgaggcaggagaatggcgtgaacccgggaggcggagcttgcagtgagctgagatcgcgccattgcactccagcctgggtgacagagcgagactccatcgctaaataaataaataaatacataaataatacagacggggtttcaccgtgttggccaggctggcctcaatctcctgacctcagatgatccatccaccttggcctcccaaagtgatgggattacaggcgtgagccacagtgcccagccattttttttttttttttttttttttttttttttgctatttagtatgacctgttttaatagcggtcctaaactttaaatgacttatttttcaatcttatagtcaaatgtcaagagtcattaatagtatctcaaacaaaacttgcattttaaggttaagcaatcctggatgactgaaaaaaatatgtatctgcttttttgtacttattttattctaaatccacattagaaaaatgtttatgattttattctttttcaataaaaaaaaacaagtgaatatccacgaagtacctgactcttggctaggtgttgaggaggaaaagcaaacccatcaatgtctgtgcacttggaaataaccatctgggagaagagaagctcctttcaacctagggatgtctatagataagaatgaaattgcaccatagaaagaaagcatatcaacattgcctgctaccaacagatggcactgttaatggtttgtatcacaactgtatttgtgggaccaatagatttgctaacattctcagaaggtagtctggaaggagaagagcctctgttaaggcagtgaaatgatatacatgctcaattttgtttaattatcttgtcaaaattcctggaaaaaaataaaaaaatatatttatatgggatatttcgtttaattaaaatacatcatcttttaccaaaattaatatatgtgaaattaaattgtagtagaactttaaaacaacatagagttcctattgctttgaataattggtctttacatttagtattatattatatgttatattgttatgtataccatatatataatgttatattatatactgtaatattagagtagcaactgatactcacaaagctaaacaactcagttccactgaaatataccagattttgacttagttttaaaagggaggacctagaaacagagagaaaatgcatcagtgggtaaaatcatttacctctaatgttttatttcacctctatggtttttagtgtactagagagctgtttaatcagaccattaccaaattgaataaatggctacttagtgattactgaactatttagtgatggggttggggagaactccttttttaaaaataagccttttgaatagttcatataagaccatcctaataaataaaatggaacagaatgtgtttgccatgtaatagcttagtgatttttaatttctgtattgtgatgaaacaaccagcttttctagaatgtagccagtcctttgtttctcagaagctgtgcacacttgcggcattcagtcctagtgctgccataacagagtttctaaacactagttcagaaatgagacatttttgtttagtctctgtttgggcacagccaagagtttaagactgtacatggagagaaacttgcttttttctgtggatgtaatccaggggacctgttgaggtctttaatgggtggctgacaggatgaactgggcattcaatattaaagggtggtatcatagcaagggggttaccccagcagagtttgtagatcaggaattgtttagagcctagatcttgggaaagtgaacaagaagcatgttaactaaagataaaaaacagaaaccaggtattgtctttttaaactctgagctcttggagtggcgatcatgtcttttccatattagtatctccagtgatgagcattgtctgttggagacactcaatatacatttcttgaatagagtaaggatttactggactttgacacagaactaaggttctgtgtgatagaggtctgtgtgcttatgagaagctggactgtgtaggtgaggatgctaaggctcctgttcccatagagaagtccttgagatggctcaagctgctggttcccttttttcttggactttgcaggtattcaaggtgtctctagttagaagctttatgttttgtaatgggtaaaaatagtgctaaaatatatagctctttgctatttataccaaattgagggtctctcagaacaaatacagtggacggattttaataataatagctaatacttatatagggccaaatagttctgagtacttttcatgtatttaactcatttaatcctcccaaaagacttgtgaaagaagaaactctcgttgcccacttctagaggaggatattaggtgtagaaaagttaaacgatttgtccaaagttacatataaattaagtgcagaagctagtttttgaaagcttggctctagcatttgttttttaatcattaagccaaacatcaaattccccttcccacactttttttttcacttttaccaaagaaatatcttaacaaaatgactcctttggaggaggaatacatgcatatatatatctgtgtatacatgcatatatatatctatatatgtgtatacatgcatatatatatctgtgtgtgtatatatatatctgtgtatatatatatacatatatatatgtgtgtctgtgtgtgtatgtgtgtctgtgtttctgtgtgtatatgaggtcagagtgagggccaagaagctattttttctctaaagtggttcatatattgcaagtgatttaattgagggaagatatagttgtattagctaaaacacttaaaagtttataaataggtgtgtctacacaaaggcaaacattcctctaatttctaaacagtttttacttctattgaattgaatatgcctaatattttagtgtcctgatgattaaagtatgaggaatgaattaataaccaggttcaaatatgtgtattgttaccatgcagatctgttaatacttattaattcccacatcagtgtgaactaaggaaaatgaaattaagttgcattaagaatgtgctcagttatatataaagatttacttcctgtaagagtgattatataattatatggtttactaaaatagttatgagattttattctttcattcatttgacatgcattattggaatcttagtattttcaaactacgtatttggagataaatattgcagtctgaccataatgatagtttaggtattccttggcctggaaggaggacactagttcattttattaacatgttctttgtctgtggagagcctccacaatgccattttagtaaaatactggatctttactaaaccatggctaccaaagacaaagtgtcattctaggcagccaacagacttcttgccctactcctgacaagcaaaataaaatagcctggggtaagagaggtaatggccatgagttaagtcattttcatagttatgctaaatcagcttccctcaggagcacccccttcctttcctttctctgtttaaatgaggtggagtatgatgtgactattccagcacactcaaaattagatgtgtgatcaagtattgatcttcaggaagttcctaatcctgtctgatgttttctgtgttagctttttttttccttctgtcataatgttagattagccagcaccttcattttgttattcccttactttttaaggcaggattcttctgtacaagaaccctgaagcgaccctaatattgtatccaaaatgtagggtcagaatcaggagtggagactgtgagttcattgtgagttaacagtctattatttaaaagtgcaacaagaaaaatagttttgctttcattccatttctgggactctaattttttccaagggagtctggcataaagtatcgtattggtccaattgcttgggatccactgagattgttactagagagggctttggtgtaaaaccccagagtaaaattctttaatgtccttttgggtcattgaacactttctaccattatgcttgacatggacaccattgaaatcattccaaggtcaaggtcactcagcaattttactaatgcttcaagttagtggaattttatttttccccccataatgcttgttttacaaaataaaatacagtatattttagtagatattgtaagatcaatttttgaaatttcttttatcaaaataaatataaattttatgaagtatctgtatgtttattatatgtaaacgtgcaattacaaatatgaaatataatttatatacatgtatctatgcatgcacctggatcttatttgaggtataaaacatgaaactagaactaatgtgttttacaaatatacgtaaaaagttattatttttttaattttatagaaacacagagtaagtaatgataaaaattcatttgtattaaaaatatttttataactacaattagtactaacattttgctttagcctaagcttaaatgctttatttgctagagtcacttgttaaaatactaaaaattttacaaggtatgaaggtaaaatagaaattatttcaaaaaaacaaaaatgcatgctgaattttctcttttcctttataaaacaagcaagtcctttatgtagatttctacaattcataattcaatgtcattaaatggcattcaatttatattttagactattatgatttcaatttgagacacaattgttttccaaatgaattcaatgtggggtatatttatgtaatagatgaaatgtatttcatctattttggaattgaataaattcaatttattcaattgtttggaattgaataaatacagtacgtataaagggaggatgaaaatgtacaactattggatgttgatagaagcattctgaataagaagcatttttacaataaactcaagtatatttttataatgtactttttaataatacactgattttaaaagtcttttttataatgtactttcatatattttttcttgagaaatcttgatcttgtattgacaattgcataaatatatttgtgcccagcacaatggcttacgcctgtaatcctagcactttgggaagctgaagagggagaattgcttagtccaggagttctagaccagcctgggcactgtggtgagaccctgtttctacaaaaaagtcttttaaaaattagctgggtgtgatggcacatgcttgtagtcccagctactcaggaggctgaggtgggagaattgctgaggattgtttgagttcaggaggtcaatgatgcagtgagctatgatcacgccactacactcaagccttacaacagagaaagaccttgtctcaaacaaaacaaaacaaaacaaaacaaaacaaaacaaaaataaataaatatcttggtatgtaagggcaatttggggttgataatttggagagggatggaaagatacatagatgcctatatctacatagatagagctctctctatacatacggatacagatataaatagatatctatatgcagatagatatatatctatgaaaatacacatctaaataaccatagatatctattaatatctatgtatctgtatctatctatacattttaacttaaaactttatatacacataagcctatagttctatatttgtagctaagtttaaaaagctattcaagggaagccctgagttgttcttttatggcatctggtggcatttcatatttgacgtgttggttgctattggtgtttgcactggtgaatccttccactggaaatttcatttcttcagggtttaccaatcacctaaaatgttttctttctggataatatcccctgactgctttcttcctcttttagcctaaagtttcctaaaaatttaaaatgcattgtagtcagctttacttacctttcacagaatagcaactcaagaagtgtatgctaagaggaggaataaaattatgtaaaaaatgaactagaaacatagttacctaagacaaaaataataagtggacaaaccaagagtaaacattttacttaagggtttaaaaatgatatcaatttttactagttagggacaatgaataatgcttatcacctccactgttatttagtgttgttctggatgatataacccatgtgtaatgacagaaaaaagaattatggctgttgaaaaggaatagatgaaatttccagaaaataagtttatacctaaaaaagccatcaaaacctattataaataacagaagtacaataagatggttagctataaataaatacataaaaataaatattttttccataattcagcaataacaaatctgaaaatgatctgattcttaatatcaattaaatatataataagtactatagcttaacaagaaatgtgcaggatctatttaaggaaaagagaaaagaagaacttataataatcattttaatacaaaagagtgaattagttgataggtagctaaaagcagaattttaaaaatttactaaaaaaagcaattttgtaagtaaatttgtaagtaagaaagaaaactggaatatatccctatctcactttacatgtcaaaataaattacaaattttatatttaatactttattttttccagaaaattaaatataaaaatacagaaaatgaacagaaaaaatataagtaagttacaaattctgggctaggaagcccaattataaaaagcaaaggaagacgccattattgaaaacatttagattttaaaacaaaaataaaccccctttttacatttaaaaataacatttaaaagtcaattgttaaaaaaaagtaaatgactttaacaagtgacagacaaagaaaccatacccttaatgtggaaaaaacgcttacagatcaataataaggatgcacaaatgacaaaaaagtatccaaatgaagaactacgatgaaagttcaaaatcactattcatcttgtaaatacaaattaaaactagaataagatttcattttaaatctatcgaatactagttggcgtctttcagaaatgccaggccaaactattcctgatgctagaaatgttttgcctgacagtggctgaaaactatttataacatatggaaaggaaattacacaacttgagaaatttcttgcagtgaactcagaaatgaaaaggcggttagatgacaatttcagttcattaatttataaattcacatgctaccacagattttagagatcatgcaattcagtatctccatttaagagtaggaatctatgggctattctgctcaggaaatcagcactatagcatgtatatgtatttcataaagtatctggtggatattactttcttgttttgtttttttttttttttttttatcatttggaggttgtaaagcatgatcagtccttataagggtcacatttagacagctacagattttaatcgttccaaggaaggaatgggggattatttcaaaagacgaaagaaaacattctttgatctaaaagcagaaccaccatttgacccagcaatcccattactgggtatatacccagaagaatataaatcattctaccctaaggacacatgctcgcgggtgttcattgcagcactatttacaatagcaaagacatagaatcaacctaaatgcccatcaatgacagactagataaagaaaatgtggtacatatacagcatgagataccatgcaaacatgaaaaaaaacaagatcatgtcttttgcaggaacatagagctggaggccattaccgttagcaaactaatgcaggaacagaaatctaaatactgcacattctcacttataagtgggagttaaataatgagaactcatgaacacaaaggaacaacagacactggggtctatctgagggtgaagggaggcagaagggagaggagcagaaaagataattattgggtattaggcttaattcttgtataatgaaatcatctgttcattgaacccccgtgacacaaattcatgtatgtaacaaaccttcacatgtaccccacaacctaaaataaaagtttttataaaacacatttctttgttttatacagaccagaatgaaatcatttctcaacacttcttttacattaaagcacattattcttgtttttttcctcaggtattgccctactttttaatcctaatctatagttccattgtaatttttagaatgctaatctaatatttattgaattcttttgtagtaagcaactgaaaaaaatttaattttcaaaaggaagaaaaaatacatgtttaaataataagataacacaactttggtattctaaggaatgtttggggattcattccagggcgctcatattttcaggttagctttcaactgttattttgtcgagtataatcaatggagattttgttattcatgtatttatagagctggttagccataaatagtttatgaatggagacatttctagcaccacctaatggcagtcaagtaaaaagaaaaagtttttctaatttaggaactgttttgcataatttaaattaaactatatagccagagttacttccatatgaaaatgaacttttacattccctaatgcactaactaggcatggaaatccatctctgagcaattggattgagtaggaatgaagctgaagggatatttgataatgaaaccaaggggtttctgctgtctttatgtgtgcaagaataagaaaatacctagctaatagaataaattaattttatgtgaaaattttctttttagtttcagaagcctatgcatactagattttccatactgtagtttcctgaaaaaagtatattttgagtattgtattggcatattttatttgtcttgtttttcagcagttatttatacatctttgaccaatttattctactagtttaataaagcgttttttaaagtttctgatagtttttttaaactgagtcatatcattctgattataatattggaattttctgttgaatatgagtcaaagaacatgctttagatccgtaagctctactcatttatttcatgtgtttcctagcaggatttgaagaatgtgttgtctgtcataaccctaggattgagatcaatggatttggttaatgtatccgaaggagaaggagaacttagcgatagcagcagattctgacacctttcatcctcgtctcaacactttggtttgatactttcttctatgatataaacagggaatactaggcagactgcagatacaggtagttttttgtttgtttatttgtttgtttgtttttgagatggagtctcactcagtcacccaggctagagtgcagtggcacgatctcggctcactgcaacctccaacctccgcctccaggattcaagtgtttaccttgccgcaacctcctgagtagctgggattacaagtgtgccaacgagcccaactaatttttgtatttttggtagagatggggtttcaccatgttggctaggctagtctcaaactcctgacctaaagtgatccgcttgccttgacctcccaaagtgctgggattacaggcgtgagccaccatgcccggccagatacaggtagttataaaaatcaacaagaaagagacagtctggtggtggtagtagtttcaagaaagtgctttctcttcgactgcaatttcttcctttctatgaacatttatttattgatgccctgtaatgcccttcacttctttgtgcacacactgaattttaattcagtcttcacagtcctgcttaaccatcacagcttctgtgaactttttctgtatatcattttgctctcatttcaacaaaattaatcacttttgctattttatagctgtagattacatatccctcttgtactgggtctttataatattttgtactcatttggatacaaatacttctactgctataggatgggtttcccttaaagtaagtattatgcctttcttgtttatctttattattcagagcaaacatgtattttggtgaaagcaaaggcaagttaatggaactgatgtatctttaagttattgtctactgtttattttctctagttttatgttttaatgtaggctgatgttttcatttcttcctttcattaatccatttctttattactgctaaaagttaactagtatttgttgttagttttttgttttcttttgttttagagacagggtctcactatgtcactatcttgcccaggctgtactcaaactccttggttcaagccatcctcctgccttggactcccaaatagctgagactataggcatatgacactgtgcctggctgggtttttgttttgttttgttttgttttgtttttgttatttttaacatcatatgatacttgattgacttttctaaacccgtggattaatatctgcttctaaagtaaaaaattgttaaccttgttattgaaagctagaaagagaaaatgtctggcttaaaggctatcctaaatttttgaaaaattcttatgagaatataatcatctatataaagggtacatttggaaaatacaggtatatctttaagaaagattcagaatttacaagaaaaaatattgaatatgaagatgattagacaattgaacaaatatgtagataaatacatcaatttttacaaaacatgaaatagcattaaaaagagaagaatttatcactgctatcacttatcactgttgcagaggtccgattaatgcagtaagaaataggagtttaaaagttggacataaattgatcagataattattattttctgataatatttcctgtaaaatccaagataatccactgaaaatatagaaccagttgaacaatctacaaattgactggagtcaagagaaatatatataaaacagttgcattcctgttctcacaaaattactcataaaataattagaaacttctgtttcaaattgggatgtagaacagtaagaaagaacttcgctttcatggtaacaacaagaaaaccagactaaagaaatatctttttctatgagtctgtcaaggagcaagcaatgcagaaaaccctggctgaattgaattttaggaagaaataagtgcttcataggtgatcagagtgctgtggcagcttccatatctgaggctaaacacttgttcagacagcggaggagtatgctattgtagatggggagaatttttaaggtcaaggggaaaccatccacccttagacaacaatgtagcctagtaagatgaaattagatctaaaagtctaaatgccaaagcaagtagctcagccccaggttacactattatcctccacacttgaattttgctaagataaagtcagttgaagaggccctagaagtggattcctatgaaattttgccatgattggattccagaattatgaataaatttaatccaaatatgagccaaaaatatttatagtcccagccaagtcccccgctagctcaaatgaggataagatccaaaaggtggcatcaccaatggttgaaggttgagctaaacacaagtgaactaaatacaattaaagcccaacttcagttctacataagtcagtagaaatgtatccacagattgccaaattactgtaattagaaagcaaagaatttaaagcaaatattgtaaacatttaaaaaaaattaaaggtaaaattcatataatggatgaaaagataaaatattttaagagataaatgatagctctaagaagaaataaaatggaaattctagatctgaaaagtataaatttacaataaaaactttattggataagtataatagcaaattggtcagtgcagaataaaagattaatgaatttaaacacatatcattatgaagtaaccaaagaaaaatgaagagaaaaataggttaaaaaataaacagatcgataacatgtggaataatatcaggagatttaacatacatggagatgtgggttccaggaagaagaaataggcagaaaaatatttgaagaaataactgttgctaaatattcaaatttgatgatgaaacaacctaaaaatgcaagaagctcaatgaattccaagtagaataagtataatatagccacatattgtatactcacagtccgattactaaaaaaaaaagattatggaaataaaaaccttaaaatcagctagagaaaaggaaaaaggcactacatagaagaaaacaatgaaatgaatgaaggctaacatttcatcaaaaataattgaggctagaagataatacaatatctttagaaactttaaaacaccaatctcaattctatattcagtgaacgtattattcaaaaataatttgaaagacatttttagattaaagaaagagttagtatatcatgaatagtcttgcattacaagaagtgctaaaaaaagttttaggctaaaaataccaataataactcaagtgtgaggaaaaaatgaaggaaaatggaaattaaaaatgtgaataaacagaaaatattattaaaaactcttttgaagacatttgattagtgaaaacaagaaattttaaacatattctgcagtttacaacatatataaaattaaactgtataaaaaatagtacaaataattggacaatggtaaatggaagtatgttgctgtaaggatcttatatgtgaagtagtataatgttaatttgtgatagtatgtgtgttaagaatgcatatgatgatccttagagagccattttaaaaagtctaaagtctacctagggagatgaaaaaggtagcaaaatggaatgttaaggtaactcctctaatccataacaaggtagggaaggcacagcaaagaagcaaacagcaaatgcaaaaaaaaaaaagaagaagaaagtaagaaaagagagaattcaaatagcaagatggtaaaattaagttaaaaacatattaataattatgttgaatataaatgcacataacacaacaatcaaaaagaatagattattaaactggctaaataagcaagacttacaaagggtgtacaagaaacacacttcaagtataaaaacataaaaagcttaaaagtaaaaggatggaaaaaataaaccatgaaacatttatcataagaaaatggtagtggcaatatttatatcagccaaaattacctttaagaccagtaatattactaaacagacattttataatgatagtcaattgattaagaagaaattatcctaaatgtgcttatatgtagtaatagagtttcaaaatacataaagcagaagtttacaaaccaaaggacaaaatagacaaattcccttctatatttcaagatttttaaatgactttcttagtacttaataaaagaagttgataaaaatctataaaaatacagaaaaatcaaacacactatcaacaaacttcagtgacagttattgtacattctatacaaaactggaaaatagctattgtttttcaaatgtacatggaaagtatgtatatttgaaagtatgtacactacaaacattctacagctaatatgctgggccataaaagaatcttaatatatttaaaaagttgaagtcagaatatattctctgtttatatagaattaaattagaaatcagtctgaaaatgctatctggaaattttctaaatacttcaaattaaacaacacatttctaaatgccctaccaattaaggggaattttttaacaaaaaataaagtataacatgaactttttggaatgcaccccaagtaaggcctggagagaaatgtataggttaaatggttatcttagaagaaaaaagtccaagctttcctaagcttcttcttaaaacaggcaaaaaagaacaaattaagaccaaagtaataagaaatgaaaaaaattaaggcagaattggatatcaatgaaatggaaacagaaagcaaagcccagaattgatttgcaagaattatgggtgttggggaatggagagtggtaaggggagagaaggaggggggagagagaaaaggagaggaagagagagaaaaaaatattttggattaattttaaaaatctatcgatatgatttaccacattaatagaggaaatagtatagcaaaatatcatattatctcaatacagctgaaagacatttcacaaaattttatacctattcataatgaaaactttcagcaaactaagaataggagagatgaaggaccactacaaatattctacagaatacatatacatatatatatatatagtatacatatatgaaatgtacactacaaatattctacagctaatatgctgggccgtaaaacaggcaaaatatatatacaatatatatttaatatatatttattatatatacttatacatacttaatatacttatatatttatatatataaatatataaaagtgaaatagtgcatgttttgattttaagatagggatcaagttttcgttcaaactttaccagtagttctagccactgctaaaacaatacgataatataaaagtcataaatatagaaaaggaaaagaaaatgtatttgtcatcgacataattttgtatgtaaatgctttaaaaaatctttgaaaaagtgttaaaactaataaatgaacttggaaagattgcagaatacaatgttaatataaacaaaattaattgaacatactagcaataaacaatttaaacaaagttggatttaaaagaatattcaaaacatagcacttaaatttaacaaaataaatgaaaatatttgtatagccaaagctataaaacataacttagaaaaatcaatgtaaacctaaatagatgaagatttatcatgtttgtggatgaaaaacaaaatattgttaaaatagccattttcctgaagtcaatttattcatttaatgtaattccaatcaaaattccagcaagcttttttgaagaaattcccaagttgattctacaagttgaaagacctagaatatccaaaatactattgaataaagtattaaaaaaatggcaaactgagccatcttatttcaagatttaaaataaagccataataattaagacttcatagtatttgtactggcaaattaatcagaaatagactcagacttccaatgtcaattaaaatttgatagaggtaaggcagttcaatggggcgagtacaatcttttcaacaaatagtactgtatagtgtataggagtcaaaaaaaaacaataaagcttgacccctatctcacatcatgcatacaatttaatttgagatgggttcatagacctaataaataaaagctgaaattataaagcttctagaagataaatgagaaaatatcttgatcatcttggtgttggtaaagatttctcagacaaggtacaaacaaagcgctaaccattaaaaaatggtaaattcaacttcatctaaaatattaagaaaatgattgccattctaactgatgtgagatggtatctcattatggttttgatttgcatttctctgatggccagtgatgaagagcattttttcatgtgtctgttggctgcataaatgtcttcttttgagaagtatgtgttcatatccttcgcccactttttgatggggttgtttgtttctttcttgtaaatttgtttgattctggatattagccctttgtcagatgagtagattgcaaaaaatttctcccattctgtaggttgcctgttcactctgatggtagtttcttttgctgtgcagaagctctttagtttaattagatcccatttgtcaattttggcttttgttgccattgctttttgtgttttagacatgaagtccttgcccatgcctatgtcctgaatggtattgcctaggttttcttctagggtttttatgcttttaggtctaacatttaagtctttaatccatcttgaattaatttttgtataaggtgtaaggaagggatccagtttcagctttctacatatggctagccagttttcccagcaccatttatttaatagtgaatcctttccccatttcttattttcgtcaggtttgtcaaagatcagatggttgtacatatgtggcattatttctgaaggctctgttctgttccattggtctatgtccaacaatgacagactggattaagaaaatgtggtgcatatacaccatgaaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccagggcctgttgtggggtggggggaggagggagggaaagcatttggagatatacctaatgtaaatgatgagttaatgggtgcagcacaccaacatgacacatatatgcatatgtaacaaacctgcacgttgtgcacatgtaccctaaaacttaaagtataaaaaaaaagaatcaaaactttaaattaaaaaaaaaatgaaaaggtaagtcaaagactggattcggctaggtatatgtttaacttagagaatgccaagcagttttccaaaatgattgtttaattttgcctttacattagcatgtatgagagtttccattgcatcacctattcagcagattttggtgtttttaatttgaccaattctagtgagtatggagatgtgtctcattgtagttttaatttgcagttcctggatgaatgatgacactgaacatctttctcatgagcaaatatggttatttgcatatcagaatttttagtcaagtgattgtttagacgttttgctcattttctattgggttgcttggctttttattgagttgtaggatttttttatgtattctacatgtccattgtaagaatttaaatttctgataaaagattaaaaaaatctatagtaactttttagcagctttttcattcatactagggacttgtattacaggttccttctcttgatttggattttggaaggcaaaattttcatcagctgaaatgtattagttcttgatttctttttgttcttacaatagctttgtatggctattacttgacaatttccaatcattttgaaatgtcttacattttcctgtatctgcaataacaaagttaagttgacagggataaaggcttttggatggctttttatgtttcttagttcaagagagacacatttggtttttgaaaaatgtttgtgttgaagtctaacatacatacagaaaagtgcaaaaagtagcagtgtgcaggttgacccatttttataacccggatagccttgtgtacccagcacccacagtacaaaatagaacactactgggcccccagtgggcctgccttgtgccctttctaaatcccagccaggattacctctatccagacttctaacatcatacgtggatttttgtctagttttgaacttgatataaatgggatcatacagtatatattcctgtgtacttagtatctcttacacaatccatgtttgtgagattcatgtatatagttgttcattctcattgctatatctgttgtttgtacagttgagtgacacgtgtgtatgtttcagtttgaaggtgtaatgaaaggtcttgctgtaaacatacttgtatatcttgtgaccctatgcatttgggtggggctggatgtagatccaggagtagaacggctggatgaaaacatacatatatcaaaagatacaagggtaacttttttgtttgtttttgagacggaatctcgttctgtcgcccaggctggagtgcagtggcgcgatctccactcactgcaagctccgcctttcgggttcacaccattctcctggctcagcctcccgagtagctgggactacaggcgcccgccacgacgcccggctaatttttttgtacttttagtagagacgaggtttcgccgtgttatccaggatggtctcggtctcctgacctcgtgatccgcctgcctcggcctcccaaagtgctgggattacaggcgtgagccactgtgcccggcccacaagtataacttaataaatactgtcagtttttaaaagaggttgtacgctccaactagtagtttatgaatgttgcatgtatagatattattacattatatattataaatttaacattttactttttaatttaatattatatataaaaatatatgtaatatatacgtgtgtgtatgtgtacatacacacatatacagtagttgcacatatttggctacactttgtgtttccttttcattttagccattctaatggatatttagtggtattgcatttcattttgcatttctcagatgactaatgataccgaccatctttttcatattttttttttctggctatgtatcttggtatcagatatatgtattgcaaatatctgctttcactatgtcatttgtcttttcattctcttattcataccttttgatagccaaaagttgttaattctaacatggtctaatttatcaacttttccctttatgttatagcttcacatttatcgtttaagaattctttgcctaatccatggccccgaacgtgtatgatttttatgattaaattttaaagttgtaaacctcttacttgaaagttaaatatttccatgtagaacttggatttttcatatttttagaatgttaggccatggatgtaagtttattttacacatctcatgtataccatttgtacaaagtatgtgttccttaaatatttcctgaatgaatgaatatagagatgcatgaaatgctctattgtttaaacactagaaaccaaaacactgaactttagaacatttcctgtctcattttttgaaaatcaaagtctaaatttcagaaagtgagaaaagtataattttcacttgtctgcccattttagtcagtgtttcagcttaacacaaacattaaaagcaaaaatattttggcactgctgggctctgatccacagctcttcttattcctgggcccaggatgataacacattcatgaggcagaggggaagacaagttcaactacacagctgtattaaaatttctgctctcctgcgcacaccgcatgtccactttcatttctttggccaacacaagtcacatcactaagcctaagtcaatagttgggaatctgtaaatacataatcttcttataggaaaagagagtgttaataattttgaatagttatgcatgttaccattctgtctcacggtagagtcagtaatgttttctttaaaatgttttatatgttaatcaaaatattatgtttatatttaaatgtattcttttttatttagttcatttaaagaattgattacatgatttcagcatttggctcaaaagatagaatttatctatatctatggcaataattaattgtcaagaatatgtttcagtgaacgtgtgcatttttaattttgtcatagattttgcacaaaagacattcattatttattttggcagtgtaaagagaaaaatgagaagattaaattatttggaaaatgctgtgggaaagtctcacatacaccatcaattccaattgcctttttttatactatagcttcccttcttaagaaattttccttgatctgtgtaaaatattatattttagttgcactagcagtgcattttctcatataagcataaaacttgaaaattaaataatatattttagaaaaacacacgaacttgcatatttcttaaatagtgcataatttttatgagattcccacgtatatcttgtctaaatattcctgtaattcttactgatttattttcattcatcagatttctcttgaattaaagacaagtagttgtcttcccagattgagcaattattgatatcttccaacacccaattccttgtttttattctcctctctactgccacatagatgactccaacacactggtagagagttttgctctcttcatgttccaaattatagcatttttgtgaaataacctcaagctgagtaattttataggaataggttttattataatatatgataccaaatatcacataaaaagtggtgacagaaagataagatttctcaagtagtgttactctgaaccataaggagagaagcttaagagaagaaaagagttggtagaaatataattgttctctgctcaggttgtagaccagactctacgtctatgtttctgctggtagatgcttccttttatctccctggtctaccctgataattaatttatatgtctcccatttctttctctatcagatttttctaattcgtgttctgtacccaccttctactcattcatttcctcagtccttatcacccagcagtcaagagtctgtccattctacttaactgaaaaagattatgtcattaccagctccgtaagtttttcttcagttctaattattctggacctattggaagtgtttacacagttaactaaccttgcctccttaaagttccctcctatctagatttccattttacaatattatcttgatctaactttattcttgcccttgtttttttcttttctgaaatgtggacatttccattaaaggctcttgttctttttctacaatctgtctcttagacatggcttttgataggtgattgccaatgtattttcctagcatcgtcttctcttctaagatttagtttctcatttccaaatggcaggcagagttttctgcatcataagttcagtatgcctaaaactaaagataattcctaaccccagatttccttccttatctgacatttctatttctgttattaatgccccattttcctcaataattggtgaaaagaatggaccattttgccccacaccatcacctcatatcaatatgtcttaatgtgcctttcctggtatgtatagagtttatcctttcaattactaattcagttacttgtctgtccttgtcttattctcccaaagcacagcactcacctcttttctgtgtagctaagttacgtctcctccctacatttcatcatgaattttgttgccttagtctcaattttgaaaatcctattcctgctctccactcaaattttaatttcttccattaatttatgggatatgtttcaaatgggtggctcaatcatttcagtgcacttaataggggagatgagagagaacaatacatctagtagcaggagtccaagtgtgtttgactactgaaaagcaatttgttggggcaaacaattctattctgtggagtggaagagttgccaggaaggactgcatcctgaatctgacagcaagaacacaacattcaagcaggccagagtaagagaagaagagagtgtgtaacaatgagaaataaaaatcactaggacaagtttgttgaaaatgaccaagagcataaaacgtagaagatggagatgcagaagtcaagaaggccaggataaatttgatttgccttcttggaaagtctaaagcttgtatcctaaacttaacctttgctgtgactaaaggaatagcactctaaaaatgacttagaacacagcattctttttcatctttgtcttctatacaaacttctcaagccagattgtacagatgtggtctcacctatttctccagatttatctaactgtctccctcacaaccagccttcctcaaactttccatacctctaggactttgtacaattcccgccaaatccttcatattctctaaaaacaagctgaagtactatattatctaaaactgtcctcaatttcttttaatcaggtattttgtatacatccctataccatttatcacattgcattacatttttttaattgtcttttttctcaactagaactcaatgtcagttatgggcttattagtttttcttctttgctgtgtatcggagtactattcaacaaatgttagtgttccatagatgtatgttgaaaaaacgacagtccaatgttcaccaaatgatatctgctttcctgccttcaaatcctagctaaagtttttctcttcagacatggcttctggagtagttgctgtctattgaaactgagttaaccaccacccacctatgtagggcttttggttaccagcccagcctgaaggaagatctccttcctttaaatttttattatcctgcctgactgtatttttactcaaatcagtattcattcattattcactattgtgttcttgagatgttatttgattttcatatatggtcttgagctcttatttgattccacaggataatttgttaagacatatacatttaatattttcaactaaactggaaattccttgaaaacagagattgtgtctcttaccagttttaatgcattaagcaaaaagccttatacagggcaagagctccacagtatgtgttgagtacgtgggatactgagtagagtggagatggggccatgtaatggtaggactggagatggggccatgtaatggtagggggaaggcatcattcataggactggagatggggccatgtaacggtagggggaaggcatcattcataggactggagatggggccatgtaatggtagggcgaaggcatcattcatagggctggagatggggacatgtaaaggtaggggggaggcatcattcataggactggagatggggccatgtaatggtaggggggtgacatcattcatagggctggagatggggacatgtaatggtagggagaaggcatcattcatagggctgttgcatattgcccctgcttcctaagctgtggaaatttctatgagaaaagagcattgtatatcctatgatatgcagggctagtatgtgctctgaagggtcagtaaagatcccaaaattctgaaggctgcaaaccatttggttatagggtggtgtttcaggaaattacctctataggcctcttcatggcaggtctttccaatattaacttctattactgaaccgattctttaaacttcataaatattttaagcaagaccctctgtgtttctttcactcttgtcaaaaacccatttatttttatgactctctgataatgttttcacattgatactctgagtatccaattttgggttgacaatatgtctttttgggttgatgagttttgcataaatttaaacttcattatatattgattagcaggaatgtgggcataagattccaagtactgaatggcatttaaaatgggatatatttaaaaccaaatggcctagaccatgcgagtatattgctgtgtataatttcctgactgtactcactacatcataaataataatgaaagtaaatgtacatttatcagaaagaatcaacaaaaccccagcactgatttgctgatcacacttgtcttaccaggcattaaggccagctttcgaacaaaagtgcctgaaggtttgattgtctttgcagcatcacctggcaatcaggaagagtattttgcacttcagttgaagaagggacgtctttattttctttttgatcctcaggtaaatgagaaatcataaactttaatatttttaagaatttagtaggtgcctggtactgaggtaaatgcttctgttttcacactgaatcttcattcaaaccttgtaaggtaagtactattattatccccattttgccaatcaagaaaatgaaacttacaaaagtaatgtgacttgccctcagctaaaatagcggagctaacttttaaaccatcatggtctgactgagaatctgtgggcttaacaaccaaaatgccaccttataatgaagattaaaacttttaaataaatttaaagagatctatttttatttttcttagtagcaaaaaatcatgtccccttttcttccttccctgtctttcttttttcattgtttcaccagcaaatatttaagtggctatcgggtactatggtactgggcgttgcagactaccatagtttcaaagttaaatatgaccatgcccctgcaaaggatacagtaaaataatcaatttaaaattcttataaattgtatcaaaataaagatttaggattctatgtattataggaacataaaataaagaaataaattgttttctgagttgtcaattttctctggaaatgtgatatttaactgagatacaaatcaatgaagaaaagttggtcaggacaagattatatgtctgtatttgagggtgtatatttcaggtggggcagtacaggggagattctgatctccacctgggaaggtgctgagcataaagtttccaggcaaagtgagcagcaaatattaaggaaatagcaaatattaagtgcctgaggtggacgagaacatggcacattcagtacactgagatgaatctcttatggctgggaacagagacaaagggaaaggtggtagattgaaaagctgggtagaaaccaagtcatttaagaccttgtaagcaaatgtgaggatatgaatttttcctaagggcagtgagaaagcactgaacagttgtcttcacttgagttgaacaaatatcagtgagcatttgatattaggtattgtattaagcatgtgagatgagtaagagaaatgagtaagactaagtaaaatatattagctttccattttctcagttcttcaacttaaaactgatgatctaaatcacacgttatgcttgacaaataaatgttttacattttattggtaaagcagacacaacgttcaccctctgtatccaagttgcgtctaggatcatggactgagtgatctgactgaggatctcagcctcatgaaccctggagatccattgaccttagagagaaaaggcagggcctattgtaccaagtgtatctgaggaccctgccagactcaaaaagcaggccaaagtcctcctgctttatgaagctgggagagccgcacagtggccactcgaaggaccagggacagaaaggctccctcctcatgacttgacagggctctgctaactccctggctggtgcacagcaggtcctcagacacaaagatttctgagcgtcccctagtaatgcagcttcttaaaggatgccagcaggtgggcagtgagtaagcaaaaggaaatagcatcacacctaagcagatcctgcagccagagggaaaggaagaagcagcagctatcgcagaaggcaagacagatggcaactgaaaaaaatttttaaaaaatcagctgaagttgattcaattacataatggaagatattattttttatttgaaaactttaagtagattaattagaggagagacactgagcctcagattagtaggtcagaagattaagttgaagaaatctctcaaaatacataaaaatgtgacaaaaacaagaaagttagatactactactgtcactaagaagcgaatcggaaggagaacaaaaagcacatgctcaagaaaaagagggataacataaaatgatgaaacaaaaaataggagagaatatctgatttaagagggaatttagtataaatccattgaaaagactcatcaatttcctgtcaagattaagcaaaactaatacttctatgagacctctttgtgccaggcattattctaagtggtctctctatacatcagtttgtacacttacatacacacatatgcctatacacacacacacacacacacacacctacacacgcacataaactcatttgaacttttcaacaactctgtgaggtagatactcttcatattcccattttacaggtgaggaatctgggccacaggtaagttaattttccccaagtcacaacactaataagtgaccaagccaggttataaacacaagcaattgagctccaaagaccatgattttagctacagtgctatactgcttttcaacatgaaagaaagatggttgttgatatccataaattcagaaaaaaaaaatccatctctgcaccaggttggaaagaaatatttcagtaagtaatctagccaaaaggaaaaataacagagtcagaaatataaaaagaagaagcatcagtgaataataaatctagtaatattaagttatgcctaaatatttaatgatagagtgactagaactctgttttacagtgccaaatgagaatctttgaaatagaagagaagtatagcaaaggcaagaaaaaaaacgtgaataatcatttgttgctaaaattagtaagatttgaaggagaggaaagatgagtgaattaaaagttctgaagataccagcttagtggcggggtgtgggtggaataagggaatagattatactgacgttttgttttcgttaaataaatagggcaaatgtttgatttcaaatgttatagaaaaataagttactactaataaaaagtgctcttcaggacatccaaattaacaaggttaaaaaggacagcaaatgctaagttaaaaaatcaacaaaaatcagaaaaagaaaggggagagtacagtaaaatagaagactgtcaatgagaaagaaaaatctggctctgctttttccccttcaacctgttagtatctggagatatttaagaagaagccagatggaaaaaaaactaatcacaggaccacttgtttatagagctttaaagtatacaaagtgagttcctgttaatgatctcatttcattcttgaagtagccccttgaggttgattttgttttcatccctgctttagatgaagtggcttaactacggtcatagagtggtttagggatagaactagcactgaattcaattatttgaatagcactgaattattttattcaatgaaactttgctaagaatttattggacttcacagttatgcactgggaacacagaaatgaacagaatgacactcattggaattctggccattggttgttcatcacagattttgagtatttatagccacccccctaccaaacatgggacagtcattggagaattaatccaaaaatgatttccccaagtctgaagcatgactgccatctcttttgacatgtggtgttgctatttctaaaggatgcgataccttaagactctgtaggataggagggtaaaggggtcaaactgcttaacggagaatggctgccaggaaactcatctggcaggtctagttgttttcatatcctttacggtgatcacctggacaggctggtgcaaagcgtggtaacagaattcagggaaacattcacagggcatttgcccatcatttccgcccccttacccttctcattcacacaattgcttagagtactcgtcactgctattagttttcccagttgctctgtccctaccctgtatagccaaaccctaagctgtatacatagtccgcaggtgccagccaagtattaataaaattgttaaagccactgggcgtggtggctcatgcctgtaatcctagcactttgggaggctgaggcgggtggatcacaaggtcaggagttcaagaccagcctggctaagatggtgaaaccccgtttctactaaaaatacaaaacttagctgggcgtggtggcaggtgcctgtaatccccgctactcgggagactgaggcagagaattgcttgaacccgggaggcagaggttacagtgagccgagactgagccactgcactccaacctgggtgacagagtgagaccttgtctcaaaaaaaaaaaaattgttaaagccaagttgggggctaaagggagtgaggaaggtttaatgatgtctagtaagtaaatttttatctgaaataatctctctccataaggtaaaactgcttgagttttcaggaaagtgacaattattttttaaaatacaagatatgggttgagcaggatggccttaggatctagctgagaaaatgtaatcagatgcattacactatgtgctcacgggccatgaggctctctatatatgaaacaacgagcttatgctagcaaggactgtgtccttccttacttccaatgaatttatactctaaaacaggtactaaacatattttctaaatttataatgaaagccccactcatttttagacaaagaagtgttaaaactgagggatggtgaaaattttgaatactcttctcttatttgctctctttttccaaagtaatatcaatgcagcttcttgtatgaagttagagctactctgggttttaaaaagtatagaagtttatttcatatgccttctattggcattacatttatttatattttaaatactttgggtaccactttaagtcagtttttctcctttaatctttaaatgcggacgagattatctagtgaatactttttatactcatcacacaagtaattatgtacttagtgtgtctgtcttatcagactgtatgatccagtgagggcaaagtctatgaatcttttgcccacaggtacttcctcaggacttagaacagtctttggaacatagtagatgcccagtaaataaatgaccattgacatattacctggctgattgactcaataactgttggtaggatactactactcataactgaagaaaattatccatttttctggcttacaacgtctagctttgtaatgattacacagatattttgtgatgtttgttttatttttttttattttgaaaaaattagagaaaaagtcttgctgttttgctcaggttggtcccgaactcctggcctcaagcaatcctcccaccttggcctctcaaagtgctaggattacagacatgagacaccatgcccagccttgttcaaatttgtctgtttttcagataatttgatttttatcaggaaaaaacgagatgcttatttttaaattgtttttactgaattcattcaaaatagccaaattttgaattatgaagagaatttcaaggaattttaaagtagttatctagcacatatttataaaataacttgaagtcattgtgtactttgctctttttaaaatatcttaataaaattgagtattaaattccttacaaaacaatttaatacaacgtagaggctatagatataaaaatgtatttggtttgtcatccaactatccgaagcattctattgaataaatgtttagggaaagggagattcttcatagtacataaaattggaaatgtgtttgtatattacaaactgggcacttgccattgttaaaagatacaataaagaaaagttaactgcaacttttaattacagtttttattgttatctccaacaattttctataattttcccattcttcacttaattaaattcaattttgaatatacttgatcagataatattttagtgaccagtaatgatctatgtttatcccttaaatattctatgttcagtgacattaacaggaaattcacatcatattctgggcttacttggaaggaagctgtgaaaatgaaagctttaaaacaattctgaatagcatctattgaatgtgtctgatatgttccaaatagaaagaacaacatgcataatatgacaccagaagtcatcacagaattgttctttcaacattgatggggggaagtaatcttaaaatagtcttcaaaaaatgatattctaaattgctgtaagtataaagtgagtttgtcatgctgaggctgtaggtaatgtacttgaatttgtctccaataaacttgatttctgatgtagagaactattaatgcttcagattgttgccaaacaaaatatgaagaaccacttattcagacacctgatctttagaatgcagcatcgtttgtaacaattttaacgctaactaagtacactttgatgagacagcatttaataaaatgctcattaatttcatcattagcaagggtatgctaagaagtaagccagtttcttatgtcacgcccaattagcatcccatgctagtaatcccattagtattgttgaattcactaatggaaaaactaatgggcatgctaccagggcacattaattgggcacgacaccagttctggttttaattattaaactacgataatgaaatgtgtgtttgtaaaatattaaaatgttgaaatagggttgaagaaaataaaagggtgtgtagacaaaacagatataaggaaagtcaacctacaaaaatacgaagactagaacttgccagatggtcatgtttctagctgatggagttgtctgtaaaagttgggatattgtccatgtgagagacaacccactcatactcatgggaaattaaaagctttttttttttttttttttactttggtaacatgaaattctgtatgtcatacatgttgtcgagctctttatgaggcccgacaggaaccaattaaatgtgtagagtggacatgttgtatcactgaagccatttcagagaaagataaacagaaatcatactaaagatggtatgattaacattgtatgtttttcaatatacatcttcagcaccattacatcaaacaattatctattttctctttttgaaaaaaacagcatagcaaaattattagagtttggtgaaattttctggtaattaagtgttttggtaatattttacccaatctaatttttttaatttttaaagattttattagaatgagctttattcttgttaagtaaatcaactttattaagaagaaaattcattcccatttagaagttgtaatttcttttttatttttatttaatagtagtactagtagctgttggtgacaaagttgggatatctttcacttagtcttattcacttaacacagaaaatgttactataggtaaccaaggctactataacatactggaaaattgtttacttttctcgaaagtagtgagatggcaggtgtttcttctatttctctttctcagtttttttttttattcttacctcctatttgctaaactctgttcttaatatctgccatttcctatgtcttatcacttaggaacatgtttttaactattatatgattaccttagccagaactataattattggattttaactacaaagcattgtgtactacatttaactccacccttatgtttaatgtatcacaactggctagtttttaaggtgaatgtcattcccatttgttattgataattttgtgaagataagagtgacttgtctgacatctctctatcttcagaactcattttgagtggtattttatgagttttaaatttttctcttctttttcatatttatgccatgaaacttaaagtctaaaattttagaatagaaaattctttacccttctgatgaatagctatattcatcagaaaatgcaagtgactttgtaagaaattcttactgcaaaggtgagacctttacagatctgtacactgtggtgcacagggaagtattaatacatcacaggaaagccagaatgatgctagacatcagctttaattttgagttctgtttgaaatgtatgcatgcttgtatcaggatcataatcttgaaacttgtaaattggtttataacaaatatgtgtgtgtttatttgtagatatgcatgtataaacatttatttattcattcattcccttaaggggtcaccagtggaagtaactacaactaatgatcatggcaaacaatatagtgatggaaaatggcatgaaataattgctattaggcatcaggcttttggccaaatcactctggatgggatatatacaggtaagtactttttgatatgtataaatagccctgttgatatgttggtgttgccatacttttctgttgtttatattcctacattcttatttcaccataatttctactcaattccatatatattgctgttgaatttgcctttgggatgctcctaaaaggatgaagtctggcaaccagtttttcatccatgaaggtctttggtaaagaaaaaaataacaatgaagtcacctatgtcttttacagttctttacaattcgtgtggacctttagttatgttctgtcatcttacttttgacttccaaaaaacacatacagtagaggaaagcagtttttgtctgcatttggagatgaggaaaccaaggctgagaaaaaagtaaatattttttcctaacttacacagttgagaggaagcattcttgggacacacatcctgttttttcacatttaagtttagtttttgctccagcctaccctatctgccacatttatgtaattataacatgatcactgtacctgtataatgatgcaggcttttattaaattattcaggaaatatctaattttaatcagtacctattatgttccaggtattgttctaggtgctctggatacaaggagcaaagagaatactgtaaaacttacattttatgggaggaatggggcagcaaaatacagaataaataaatttaaacaaatatcaagtggtgataaattctgagaatgaaaaagccagatgagagggaaagttgtgtgtgtatgtgcgtgtgtgtgttaagaaaggtctctctgatgaggtgacatttgagcagagacctaaagggacaaaggggaaaccatgtaaatatccaggaagaggatgctttgggttgcgaggacagcaagtatcagggccctgaagtgagagcacactacatgtggcatgtcaaggaccaacaagaaggccagtgtgggaaagagggtgtaaaagagctaatgacatgacataaggtcacagaggccattagggatcagattatatgggaccttgtgggcttttactttgaaagaaggaaactgttgaaggattttgagggaagaatgacataatatgacggctttctttaaaaggatcacactagctgctctgttgagaataaattttaaggggaatgagggtgaaggcatggagatcagttaataggcttctgcaataactctgtaataattcagacaagaaatcatggagacctgaaccagggtgataattgaagatataataagaagtattcagattctggttatactgtgaatgtcaaattaacaggatttggtgatgagattgaggcagaataggggttggtaaactatcaccatgggctaaatctagctcatgcctgtttttataaagttttattggagcacaactacacccattcatttacgtattatctatggctgcttgagtctgaatagtctacaaagacactgtctggcctttgacagagtttactggcccttaatgtcgagcaagcctgtcaggtttgggtctcaggcaactggaagaatgtagctgccaaaaccagggagtgcatgactgtgggagaagcaggtttggggagagacattcaaagttcagttgagaacatgttaaggctgagatttctaagacacccaaggggagatatcaggcaggctgctcaagaaacaagtctagttctgaagtcagaacttccagcaaaggatggtattgaaagccaagggaacagatgtaagtagggctaattggagtggattgggctctggaaaaacaaacacaaataactttgcctcttctctcaaagaaggtgggcattagaaatatgaacagggatttccattgttatgccacacagtcagagacccaggttcccctggcctttggccctggcagttcgtactggaacccagcccactattcatccctctagagtacttagggggtgcctatgggtagagaaaggaagaggcctgagaggcaggcggtctggatcattccaacatcatgatgctgggatgttgaggaagagccagtgaagaaaagtaatgaacaggcaatgaggagagaggaaaaccaagagagtggtatcccaaaggctggtgaaggattttattatttgctgagctagtaaaactagagtatcctggtgaaggtgtatttctcatctcctcttctctaggttcctctgccatcctgaatggtagtactgttattggagataacacaggagtctttctgggagggctcccgcgaagttataccatcctcaggaaggatcctggtgagtttagtaaggtatattatatgttgtcatccaaacttagaatagaacctgtttacattattttaaagtaagaataagtattatgttctacctcatgctatattttctatattaatgtgccaaaaatttcctttaggtctcttttttttaaaggaaccatgtattccatatgacttgtatttatattgttagtactcggttcttgatatataaaaggaattcattaaaacttttgctgaaatgaattataataatttcagtcaaaggtatgttattttaggacctatgcatagttttttctaagattttaaattgaatgtgaaacaacacagaaatggaaaactatgagcttgatttatactctaaatagggtgaagaacattccctgaatactatgtgataggcactaaaccaatccctagatattcatagatgaataaaatgtggtctttatcacaatagaggtcacaggcgtataaacagacaattccagcctaatgccattagtgctataattgagctatagacaaagtgattctcatatttttagaacaagagcataagaacatattctaaaatgaaactaattaaaatgaacatgaatggaattaaccttagataggaaaaaaaatcacccttcaaacgcaatgctaatattctaggattgtttcccaagtcctcattaagaatcacagggtgcctcccaagtctctcccaggaagttaaaatataactacataaatattacaaataagctagaacccagataagtataatttgttcatgggttgcagtctcagggaatcatgatgaagatcaaaaggaatagaaagtgttcatcaaatttaggagaaggatatagttgaatcctcaaggctgattatagttacctcctcagaaatgtctctagattagagagggttttcattcaactacttgagactgacagagaagtccctctaaaacacacacacacacacacacacacacacacactcacgtacacagcctttgttttttgcccttctgggaaatagtatcttcaggtactaggagagaataccctgatactaagtacccttcctgtagaggacacatctccattatgaataaccaattttactttgtctatgtaaattggccttataaaactctcataaactcaaagctgaaaactaagctttgcccccataggaaaggaggtggctgtgtgaaattcgacctcagtgcaccttctcctcctcttgatttttttttcttgctttttctctaattctctcatttgcacattttctctctcaaccttctgttatcaccctattcactgtatttataaagccacctctacctggtctggagagttccacattcaagatcaacactatatacatttcccaaaatatgaagccaaattattgatttacttcagtaacagactggttcatagatgaggaatctaaactgtaaactatatattaaatagaaacactcccttccaatctaacttttaaaattatagtactttatttttgaggctagtggcagatgaattttctgtgttagttgaaaaggcaatattcttgctactgcaaaaccaaggtttctgcataaacatctgtttctgcagatatgatgggtttgaaccagcactaaacattataattgctatcatttactatagctgatggtgtggtgtttacatgaatcattaagaggcttgcagtaaataggtagtgagagctagtgcctatttctttgactttaatggcacataaaattaattgcttgaaaataatctttcaaaatatatatttcttgatatctataaactcctgcagagataatccaaaaaggttttgtgggctgtctcaaggatgtacattttatgaagaattacaatccgtcagctatttgggaacctctggattggcagagttctgaagaacaaatcaacgtgtataacagctgggagggatgtcccgcttcattaaatgagggagctcagttcctaggagcaggtaatgctctaaaaaagacatgagtgttcacttaaaatctatgttctatcctttgtataatttaatctctcctgtttgattaacttgacctcatatgaacctagtatcacagaaatacttagttattccaatggtgcacacaaatatattcttgacatctgaatatgcaatataaattataagactcataagtatacatccatgtatgatatctctggtaactcatgcagttcttgatttacatatgttagcatcaccaatgtccatttgcaaatcagttgtttggaaactagaatgcagttagagaggtgtacttagaatgcactcagaaagatgtttcaaagagttttgtttactaggttaatccacaaatgcctatttatctcattatatagaagaacaatgttcttagttaattctcggctaggtaatgggttaagtaggccattgagagagaactggagactagaaccaccatccctgccattgctcaaaaggctacaatgaaaggggaggtgtaagtgtctgtagcttacccctgacatgcatgcacattgagtctctgcctgatcagagcagagacttccacccaggggaaggggagagggatgatggtggcttggtgcacccggcttgttcatcaaataaaagcccatcactgcctcctatatttacagctaagttggttggttattaagttgcttaaactgccttcagcacaaaaaggcatatgatattaataatataatctacacattttttattctgttttcatcaaggtcattctgagtttcttttagtcaatgcaaactacttattgttaatatttatctgaaacagtaataatcttacatgatacagacaacacatgatttagagagcaaatttcttcctgttaaaaagtataatatatatcaaagtctttcttagtatatcaaggtctttctgtcacttctgtgcaattacaaaaggaatttcttaacattgatttgcatcttcttttgtgagatttactcagtggcagactgtgtcctagagtttcttagcacccttacaatgctggcaatattgtgttacacatgctaatatgtacatatttttatctttaaagggttcctggaacttcatccatatatgtttcatggtggaatgaactttgagatttcctttaagttcagaactgaccaattaaatggattgcttcttttcgtttataacaaagatggacctgattttcttgctgtatgtgaattaatttgattaaaattactttaaaatataggacccaactttaaaataaataaaccatgtgttggcattacacttaattggggtttctttacaaattcacatttgttcattttttttcccagtcatttttagttttgaagtcctgtgaaacattttgtattttattatcctagtaattttttaagatgacaattgtaacaattataattttaagaaaacagactagatataaggaattaagaaaattcaatttagtatcttaagatatgaaaaacactatttccctcattatcttttgatatgagttttgaaagcatatatattatatatttttcatatgacatatagataatcaagtataataatatagtgaacactcctggacctaccaccacgcctgataactgaatattatcatttttggtctatctataaagtctttcctatcttgtttccatctcctttcagatgtcataggtaatcagaattttgtatttgttattcacatgcatttttatagtttgaacacctaatgaatgcctacaaattcttgcttttgaaatttataaaattggttttatactctctctttagcactcaacattgtttctgagtcatttatgtgtccacataggtatacattttcttggctgtgtagtatttctcttctcttaccaatgatgtattggttgttcccatgttttgcttcaatgaataagactgctataaacatttttatacatttctctaaatacaatgggcaactgtaactgcttttccttgtctttaatcattagtttgataccactgttaaatacgttattaaaattttaattcttaaaagttgttttaaagaactagcatagaaacaggagaaaaatatgaacatcttacccttagattcttgatttctaggcaaatagacaaatacaagtcttggcttttaagagtctaagatacgttcatctttttttttttttttttaacattcctagcatacacaatgccaatattgctaagaagggaaatggaaatttatcccttcatagtatttattaaaatttctgcttttttaaatatttgtttgtcctcttgtgtattgttggcttctttctctgaaacgtaatgtctatgaatcttctctgaaatgtaatgtctatgaatcttcgctgaaacgtaatgtctatgaatctaaggaccttggttctcttctttatagttgtatcttcagtgcctaagccttagcaattatcatgttaatcaatattgttgaatgaatgaatgagtgaacatgtgaatgagctcatgctgtggtgaccttcactgagcatcgttgagtcatctacatgtgcatacactgtggaggatacaaagatgtttaccatttggctcctcctcttgaggaccatatgcctgagctggaggtctatatgccctactatgccatgcttccaccctccaccttcctctattcattgctttgttactgtattaaataatactgttaactttaagtaactcttactaaaaaaaaaaaattaaaaaattaaggctgggtgcagtggctcacccctataattccagcacttttagaggcctgggattataggagggtagcttgaggccagtagttcgagaccagcctgggcaatatagtgagaccctttttctatgaaaataaaaataaaaataaaaagttagccagacactgtagctagttccagctactcgggaagctgaggcaagaggattgctgaagactgggagtcgaaggctgcagtgacctgtgattgcacctctgcactccagcctgggcaagagagctctgtctcaaaacaaacaaaacaaaaaaaaatcaatacacttagataaatatatacggagtgcctattatgtgcttggctttcttttaacacttcccatgcaactgaaaggaagcagtctttcataaaacttaacattacggtctgccatatctgaggactgaggctgctcccagattacccctcaacaactctttctattatactgacttatttcaatatgcatggttatcccctggaacttgataaactcagaatgtttccattgctgaaaccttgaatctcaaaatataacctcatatccctctagctctctcagtctctctcattaagttcaccaacgcattgacaccattggctattagcccactttctagttaacttacttgctccttacctgagccactataatgtatttcttcaaccatatttctaccaataccctgatcttgtgtcttgtattgggcttcacaaaccttgatccatcagtccagccacctcgcttttcagttctagtagctagattgctaaacactataggaaaactaatacgggtatgagaacttgttttgagctctccaattcttttattaaacagtatctattgtttacaggattttctaatatattttagatgtagaaagtgaaagaaaaataatcttaggatctagaaacactataacctgaatgtcttcaggtagtctcacactctcctgataaaaacaagcatgcatattcaactttcagtctctctatcaacttgaccgtatttgagccaagccagatttcactctctaccgactcaggggaacaaatgaacaattaccatgcttacaaccaaagaaaatatgtctaccgtcatcctagattctatcccttcctctgtaagaacttgttctacagtctcccctctttgtatgttcaactgttccctctcaattggctcttttccctcaatatatggaatgattgaaatttattttccttagtgttttttcttttgtctgtgaagcctcctccactgtacttttccttaccttcatggtcaagtgcattgaaagtggttacttttgttattgccactttttcatctcacttcagtccctaaaatgactgtacattaggttcctgcccctaccacacctttctacaaaatcacttttctaaagtggtcaatgacccccacatttcctagcccaatgatttttatttcttatattttttgtcctttttctgtcattctgtttttttcttattcttccctactgattttccaaaatactagtttctcctgatttcattaagttctcttagcttctttaaggagatcattgtcacttaaaagaactattttctactacaagacccttaaaacattggtcttgctgaggacactaatcttttcccttttctctcagtctttttacactcactgaataatcttatttattttgtcatgtattttctcctttttgctgggccatccccaaactgtgtatctttatgtttgacttcctcaaaaagagtttcatctggatgttttataggcatttcaaactcaatatatttaaaatgaactcacccctcctccttgtcaacaacaacagtcagcatttctttcaaatgcttttcataacgtgatgatggcagaacaccctcctagttacccaaaaaagatgagatgtgttcttaatttctttttaattcatctaactcatttaccttttttaccaggtcctaatgagttgcttttacaaatacttctaagattgagtcttctctttcatcagcatcatcattatccttattttaatgactctcaatatgttttcacaattaaatggatttcctaatgcatttcctgaattctagtcgagattttgttttcaatgtgtacttcttatgtctggtaggctaagcttttagtgcaaggtaatactgggaagaatatgagttttggtttcagacagacaccaaacattctttccataccagaccctcctatcactgaaagtcctttaaaatctggcttctacatagctggcaagacactacctcacctcccacctccatatgtaccctttgtcttagctaagttggtgcctttctctgaacctgatgtcctcatgtcatgcatattagtccccctccttgggggaccctccatgaatcttatatagtttctaaaaccttgctttaaacctttcccaatttccagggagcaaaaagccttctctgttctctgctttcactttactcctttcttgtcttgattgttgtattgctcccacatgtttgcctctgctactagacagtatgactcttaggagcagtgtttaccttagagcagcaggtatatggcacattgtaagagactcgatatttattgaataagtggttagacaaatgaaaaattgcttacctgaggtccttcctgaagatgatgcttttatggaaaaattcataatttttatctggcatgatttaatttgttttactcgacacaattgatctcaagattttaaatatcatatggttactgatatggtttctaacaaagtaaaaatatattaggtaaaataattatcatgagacattttgaaggaaaacctatgaacttattttttactatgaaaatttgggtgaaatatgttcacattagaaaatggtacagtcatctaatagaatacacatagaagcaattatgttagttaaagatttagaataaaaccgaaatattgaatcaaaatatgtcttacatatttgaaattgagttcactagccagttaaaataagcttaatcaagcttgacatttcattttcttattgtcttgccatattttcccccaaattaaattgatatatgaagtagtattttctcattttctaaaaattcaaagagtcatagttcaaagtgttctgttctcttcagtcattcagtcacttatgcaggggtttaatcttctaactatgttgcagcaaaagtaaaccttaggtctacataacatcgcatcacatcctataatcattagtaggtatgaatttgtttgcatcaatacaacattcttcatgtcaactataagctagaaaagtgtttcctatgttcctaagcagaaacttagggtagagtgacacatttctatagagtgctttcagggaactgttttgcttttcttcaagaaattgactttctgctctctcccaaactgcccttctgcagcctttttatatacctactttcttttttaatataaaatacagatggagctgaaaagtggaatattgaccttccggttaaataccagtcttgcctttacacaagtggatctattgctggggctatcctattgtaatggaaagtggaataaagtcattattaaaaaggaaggctctttcatatcagcaagtgtgaatggactgatgaagcatgcatcggagtccggagaccagccactggtggtgaattcaccagtttatgtgggaggaatcccacaggaactgctgaactcttatcaacatttgtgtttggaacaaggtaagttccatctggaggaattcacaaatccatacagccctggtgctaacagtttttggtggttctgtgtttcaagagatagcaatagactcaggctaaaagcagcacccaacagcatctctttttctggagaaatttaaaccttaaaaactaatgaaaacactttttcaaagagttttgtgtgttacccttaacaatgtgccatcatttataatcagcatatttatttcaatatgtcctcagtaaatagtaattaatatacatattattattaatgtgacatataattatatatgtggtacataattatatatataaattactatttactgaataaatatcaaaataaatatgttgattataaataaggtaactgaggtgcttcccaaagatgatatttatatggaaaaattagtaatttatatatttatttaaatatgtaatgcaattatatgtgagatacataattatataagaaatatatgtgtgtacatacataattatatatataattatatatataatgcatataaatgtatttcctcatatgttggataatgatcattatctgtatttacagatgaaaaaataaattaagttggtatgcataactagtaaaaaatatcaatgcaattcattgccttttctttctttgacataaatgctaattgtctccatagtttttcagtagagctttcatgtggaaaaaaaatgtggggtgtatgtggttgacttccaaacatacttgtgaaaatctatatattgtagattattaataactataagagaaaggaaaagtgcattatttacaatttaggtgagaagttaactcatagacgtttgaatgtaatcagagaaataattaatttgaaaaggctaacaatatctgtgtatcatttcttgtggcagtcatggttctgagagcttacatgagaataggtgagtcaattattcataacaagtgtgttaggcattattatttatatcctcattacagatgaggaaactgaagagcagagaggaaggtaactttcccaaggtcacatggctagtaagcagatagcaagacactaagtctctcaggcagcctgttataaagtcaactctcctttttacagtcaatgctctcttttatgggcattggtcaatgctcctttgtaaagtggggaaagcatagtaacttccagcataggaccaagcaccctcccacgtgtgaaaaaggtcctttacgtatttcaaaatctacataccctgaatggttaaaattttcatgaggcaatctttgcctatttggtaagtacataaagatttaaatgcctttgaatagaaaatatatggcaagctcttaggagacttttagaagggtagtagtaaggagttaatgaataactggggtgtaagacagtaatgacattttcaaggcacttaagatgtaacagcagctaaaaatattacattcatataagagcttctccaggttttcaggtttctgaggttagaaagaacttgaaaacccttcgtatgagtgagattacttaatcctgtttgcttctgggaaaaaaaaaataaaaacaagaaacaaaaaccctgcatgtacagccttgttctttgaattacccctaaacccattactattgatggtcctaaagacgtggctaaaaccaaaattgtaagataataacagaagtttaaaacatcaccatagacccaaagggaataattttacctacacactatgactaagtctgtgatactggaagatattttattagtgagtaatattaaatttttattactgtagtatcatccatatcagtggtctcaaaacactgaaaaaatattgacgtatggtagctggaacgtagaagtcaaaattagccattatttttactattcaagatacattgacatcacctggaatggttattaaaaatacagatgttagggacccctgtcccctaagattctgactcagatgccttgagagacactgatctatataaatagctgcatgttttatacggtgatcagggagactagtcacaatacagaggtgcagcatgtatgtagtcaattgcaattaaaacaaatcatgttcatttaatgtatttctttcaacccactatcaattgtcttaaaaacgtttttccttttctctgcttcttaattagcaccttttttttttcatcagaagctctattttgtggtcatattagtgctattttttttttaatctactaacgttgcaatcttcctccgaaccagatacaagactaattttctttcttgttttgaaaatgctgggcaacataatttgctgaagatgtgccagctcagatgatgagagtttatcttcttagaatgatcaatgaggataatcacttacatctaggttgggcatgactgggtctggcatgtggtctcacaggcaatgctctgcccaaacccctccatggagagggagagagtgggggctcaaatttagcaggcctgccaagccaagcactctgcagcagtactgccttccctagaggaagggctaatgtttttctgattagtcatcttagagctctgggccgccttttaggcatttagaggcccaggggtggtggtgtggatggggatttttttggattctcacaagggtagtggagtaagaaaagaaagcatttccactcctctcgcaaacatcccctttctccttttgttgtcctcgcatctcattcaaatgttttaggtctggggagcatttctggtggtacagagttgaaagcacgggacaaccttaactgaactctttggttgccactggaaggaccctgcactagagctcagcagcttcaagagctcagcagtctccaaggccagaggccagaggaccatttccttaggaggattagtgcttacaaacttcattttataactaactctctaggcctttttcttcatctccaaaatgaagaaagatgtatctccctgggctttcccaaattgaaaatttcatcttgtgaattaatttttatgatgttttttgctaaatttttaattttttaaacattatggtaaaatatatgtaacatgaaatttaccattgtaaccatttttaaatgtacagtttagtggcattaggtacattcacattgttttgcagatatcaccaccatccctctgaagaactcttttcatcctgcaaagctaaaactatgtacccctcaaaaaataatgtagcatttcttataacagcacttgtttgccaagctgccctttcactgttctgattttgttggtagggaagttagggtacagagaattttgataatacagttatgtgccatcagaaaattactactgataaatacattaaaattcttagcttctgaattttccagccaatgatttcatattgagcttcattgctttcaattcaattcacccaacttattgagtgtctactgtgtgtttaagatagactagcagtattgatcagtcaggactaaaaaaatgtggataatagtaaaagacatttaaaaggaaataggctgcaacttaatgtgttagaaggcataataagacatcatatgaatgctgaggagaacaatatggtcattgttactattaacttattttactgttatgcatttcattatattttatttccatttcctgctgctgtgctttaatcttgaaaagagctgatcatgtgtttgaggcctttcaaactttacagtgttttgttcggagagagagagagagagagagagagaacatgcacgctacagcaatctcaaactcggtcctgtttgtcccaatttcgtgcagttttctgcgcagagtactgccagacttcactgagctgatctctgttttcacaaaatagcatgtaattcaaagccactgctattccctggctaactggatgccttttttgtttgctgtctaacaaaaaagtggtgaatactctaaattcatttcatccgcattctctgttaaacttcacagaatggtactgcgcagtgggtgttctaaggtcacctgtgcagaatgcacattccatgaaatctcatggtgttgctattgccaacagtgaaggctggcccctgtcatgctaatggggatgtaaaactggtgaccattttgtatgttcaagattatggaactctgtgaaaaatgatagagcatagtgacagctcttctgtaggctgatgtaactcgggctaaattctatacctctgaagtgatcattatgccattcatggcaatatttcaggactaatatattttgaaattatgttctctctcctggtattctacataaaatgctcagagtgtatttttccccaatgagcttactgaataatcatgctaattcaaatattattttttggcacttaaaactgacttatatagtaacttaatctttcagaattaagagacatggggctatccccctaccataatatgaagttgcctaaattttattttatgggaagaagcggaatttagaaaatgtgggcctaaggaggtaaaataaatgctttttcagtaccaaaagttaaattagaattatccattaatgtgttttccaaataacagaactatatttctttgcaacaaattagcttgttaaaaagtaggaggcataaaaggttttccaaggaagactcgaaagtctagcaattgtatctaaccaccccccttcctcaaaatgtagtgctgcagaggacaaaaatgattggtaattaatgactcaagccctttatgcgatactaatcccttactatttgctaggtttcggtggttgcatgaaggatgttaaatttacacggggtgctgtcgttaacttggcatctgtgtccagcggtgctgtcagagtcaatctggatggatgcctatcaactgacagtgctgttaactgcaggggaaatgactccatcctggtttaccagggaaaagagcagagtgtttacgagggtggtctccagccttttacaggtaatgtggaggtcctctaaattaaatgttacatgtctcttattcatccccctttccctccctgccagcccctcattaatctatatgagtattattttaatcttgctgcatcttatttccatttaagaatacctgtatcgagtgatagcctcgcatgaaggaggttcagtatatagtgattggagtcgaggacgtacaacaggagcaggtaaatacttatcttcaaatgcatatgtgcacacacacacatgcatgtatttgtgcatttatataaaaggaaggactattaccctgaagcagtaatatttttgtagtcttctgacagagcatgccttggtttgaaaatacatctgtcaatggctaaaatgcttagtagatcagtgcttttcatttaccaagaattcactaaatacttgctcagacttgatcctttcctcttaggatgcagaagtaaggaaagttcaggttgtcttaaggatgtaatagtcccacctacctaacatgtctaaggataggtaacctttacagatggtgtagatagcaagaagctgaagtcagggattaggattatccttggctgggagtggcaccttcttgactttctcacagaaagcacatttgaaacctgcaactggttggaatcaggggtgtctatgacatcattgcagatgtttgccccgttgttgactattagaatcttagaatgactctcccaagagagaaattgctgattggtttaatatattttgaattggaaaagaaccaactaggagacagtatacattagacctaatctcagacaactgacttgttttgtacttctgactggccacaaaatcttttcccaaaataccaccacaggaaggcattcagcacaaagagttttgtgaatcagtgacattctactattttgggtcaaatatttgtcaggaaactgaacacatctccagatgattgccacttatgtctcagcaaggaagtttattcagcgagtatcaatttgtctaaagacgtgtttccatcaaggtattctcttatacttaatcaacagtaggttactatcccaggcatcctttgaggaatcttcttaatctaaaatataattaaatactgagatgagcaactaagaataattttcaagactctctacctacatattttccagaagaggacaacttgacacttttccaggatgatttaaattatcacctatttataggcaagacaatgagctgaacgatctcttaaaattcttttcaacttcagagctaagagaaagctccaatataaaatactcacttgttactgacatgttctctgctcctatttcacactcttctactttattaacaaatataaagcccgctttgagtataattcagcaacattaataggcgtctggaaagcacattgcttacttagcttaatagtccccattttgagtactactgagaaagtacacaaatagagctctgaatttatagcaatgatctgaccacagccctatgccataaattcatatttacaatctgaccacaacactgagcagctacatgctcccaagggttggagaataattgcactatttaattatttttgagtcagttttgctctgtcccttatgagaagaccatctgttagactgtactgtactttgccctgtaccacatttccgaactaataaaatcagcgtcactcccattgtccctttccttgcaactcgatcttgtggcctgtgtgttttctataggtgtctgtagtgttttaactgctcagagagtggttctcccctttggtgtttcctcttatcttttatgttcactttgtttcccttaaagctgtcctactttattggtctggacagtaaagtcggagaggaggagatttgatgtggaaaaaccagagtgatcctccatcgacagggctcaggagtccatgagcagctagagcaggtctctcatccatcatcctgccacggagttccttgggctctttctttgtgtccccagtgcactcagctgtgatgaagtttttactgatcagaactgtagaaatgtctaataaatagttaaaggtaatagattttttaaattagggggctcagcttgtaagtaaggttttgcagttcttttaaacttcctcattttgtgatattattttgaaatattctgcagaacaagactttgaaaatgactttgtagaatctcaaaggcaccagctcctttaccccacccccacccccaaaaactgcaactaagaatatattccatatatcatatctggtagaactttgctttttaaaaattaattagaaaaacaattgcatttggaaaatgggtctaggcattcaagtacaacacaatcacatttgtgattttttttttggctaatacatcgaagatataaaagtgtcaaactactatgtataataacagtctaattatcttgcttcaaagggggtacatcattatattgcttgaacttgttatctgcctaccatccacctccttctttatgagtgatgtttaaacatgtctgatacattaaatgtttttggaaaacctggactagacttgaaagaatgttatgtcgatggagttttgatggttttgaaatatcgcttaaactgaatggctcaagatgtgcagtcatattaaatcaatgctgaaaagttacaactctaataaattgtatttatgctaatggttgagtctgatttactgcggccattaaaagtgaagaataggagcaatagtcttctcagaactgccattttccctattttctcttttattccttcacagctccacaaagtgtgccaactccctcaagagtccgcagcttaaatggatacagcattgaggtgacctgggatgaacctgttgtcagaggtgtaattgagaagtacattctgaaagcctatagtgaggacagcacccgtccaccccgcatgccctctgccagtgctgaatttgtcaatacaagcaacctcacaggtaaatgcaatcctttaacagagtagaccctattaacttcctttttgtttgcattttaaataaaaatcttctgcaaatgttttttagaaaaatgtattaaatatacatgtattttacctgattaaaaacaacacccatctaaagtagtggaagcctgcatctacctaggataaaaaggataattctacaatgcgcatgggctctcatggataattttattctaaggtagatattctctccatcccccaaagattacatcataggtggctatagccctttaacaccttatagacatcttttggaaatcctatgtataaatacttatttcacaaagcaaaaatttactctttgggactagccccagttcataccactattatttattgtaaaattgctgattaaacctaattatctcaaggtggaggagtcttagagccccagttagttggactggcaaatcagtgaatcgatttctcacagtgtggtgtgccatgaagaatgattataatgaaatatactcatacacaccactaacacatctcacactcaaattcatgcgtgtgtattaagagcatttttcagcttcatgaaatattaaagcacatttaaagggagagtttaatttaagcctttgataaaagggaagtaaatgtgtcaaatttgacagaaaaaaaacattttcctctatcaaaaaatcctataacgtgaaccatcagaatggacgttagaaaagccttaaatattttcccaacaaacctgttggtcaattccctcaagactttacttccttctttagacactttggaatgcacagcccaaatatactaccaacttttagcaaaagaaaaacaaattcacacccttcacttctttcctattttaccctccttatcaaagcccagcctgagtaagcccacagcttgccttttcacaggttgcatatggcagctacatgggctggaaaataccaagtagtttattgctaaaaatgctcaaccccactttcagatgagcactcagtaatgacaccaaccctactgtatttccagaatagctccttcccccattctcctcattaaatattttatatttttccaaactatacacgttacctccctttctcatcccactcagctgacagcgttctattttagattatattagacaccatagaaaaaacaatttattttataggatttctattactttcttactaccaaatgtacatattaattgcatttttctgcctgatggagttgttattaggggttggatgaatgaatgcatgctaaaacacataaaaccattttgatatacaggaggtgtgtgctatgctataattttattttcattattatttttaattttcacgctttttttcctttctgttttacaaagcttctcttatcctatcaaaaatagaaatcttcacaagtcctctggaccctgactctttctgtttcttcagagatattactgatagcttatcgtcctctcacttatatttttaacgcctctgtctgctgcagtagagtatggcccaaggaccagcattactagcttcacttgggaacttattactaatgcacattctcctgccctgcccaccccacacccgccaaatcagacactctgcagtgtggctcagcagtccttgttttaacaagcccccagatacatctgatgtatgccagcatttgagaaccactgactgggtggattcttcccagggtcattcaaactcttttatctcccattgttaaaaaccaacacactaacccaaaccaatcacaaaaatcttaattctgtccaaactcccagctattgctccctctctcctcctctcggccttcgtctagcatgaagtatctaagctcattttgtcctcacttaactggcttctgctcattactttcgtgacgagcaccaaaaactgccatgtttacataggcaaaaaacacttgacactctatgtcttcaccactcttcagcattctccacagtaactctttcatcatttctagaaatatttcttcacttctgtgacttttctgcttacctcctggttctccaggggccctgttctcagtgtcctttgctcacttcttctaaagtgtgacaaaatattgaagagtctcaggatttagaactgggccgtcttctctttctctttcatttttttctggcttgctccagaagccttattgactctcataacatcaaataccagatagatgctgctattgactcctaattgtacatcccacctagacatccaaatgcctgcatccaataggcgtttggacacaatgacatttccaactggatgtctctcaccttctacccataccaaacctcaactcttgcttctcctgcattctcatagatacctccagccacccagtcaatacaatttgagagttactctggacttttcacctccttcacacctcatatccacagttgtcattctatttttcaaaatatgtgttaaggtcatccatttctcctctaatctactggccagcccaaactactaccatctttttcctggacaactgcaatacttaccttcatctttttcatagccttttttttttttttctctccctggccgtgagtgtattctacagagcatccaacatcatgtccctctcctcaaaaactttctttcttttttttttaattatactttaagttctgggatacatgtgcagaatgtgcaggcttgttacataggtatacatgtgccagggtggcttgctgcccccatcaacccggcatctacattaggtatttctcctaatgctatctctcccctacacacaccctccaccgctcgacaggccccgatatgtgatgttcccctccctatgtccatgtgttctcattgttcaattcccacttatgagtgagaactcgcagtgtttggttttctgttcctgtgttagtttgctgagaatgatggcttctagcttcatccatgttcctgcacttcctctctcacaatcacactttgtctgggtctccccctacttccagggtttccaacaattaccgttgtaattaatataatttaaagaaatttgtatgtaaatccttaggagaattcctgacaatgatgatataataaatccctagcagtggaataactgcatcgaaggcttttaagacattgtatagtcttgaactttgaagtcagacattgatataaatctctgctatataccttccctgtggataagttccacatccttctggatcctaaagtcctaacctatgaaatgggagagtgatatttacctcagaagaatattgaaaatattaagtgatatgatattctagctctaaccctttttagctgtgtagcttggacaaatcaataaacctctgtttgctttaaaatccttctaggtaaataagaatgagatacaactacatgcctcccagggcagctgtggggattaaacgaattcatatgtatgtaaagcacatagcacagtgcttgacatgtggcatgcactgtatcaaagttacctacaggatatctgtaaagtgtgtaacattatgcttaatgcttggtaatttctcaagaaatggatagcaattattattattattattactattattatttaatgaagtctcactctgtcgcccaggctgtagtgcagtggcgcaatctctgctcactgcaagctccgcctcccaggtttacgccattctcttgcctcagcctccccagtagctgggactacagacctccacgcccgggtaattttttttgtatttttagtggagacagggtttcaccatgttagccaggatggtctcgatttcctgacctcgtgattcacccaccttggcctcccaaagtgctgggattacaggcgtgagccacagtgcccggccaggatagcaatttttacactgcccaaaaagctgtacaaattatgcttccaccagcaagcagaatgcaagattgtgcatttcattttatctagccaacaccaaggtttacacttgaaaaaaattgcaaatttaaaaggcaaaatatatcagaatattgttttagtttgtatttatgtgattactagagagattagttttttaatatttattgaccatttctacttcttttatgatgtgcctaggtaggtccattgttttttattttttattttattttatttttttattttttgagacagggtctcactctgtcacccaggttggagtgcagtggtgcaatctcagctcactgcaaactctgcctcctgagttcaagagattttcctgccttggcctcccaagtagctgggatttcaggtgtgcatcaccacgccagggtaacttttgtatttttagtagagatggagtttcaccatgttggccaggctggtctcgaactcctgacctcaggtgatccaccagccttggcctcccaaagttctgggattacaggcatgagccactgcacccagctgcattgctaatttttctattgaatgattcacattttctcattaaagtttttctctgcatatgaagaataatatacatgtttatctcatctaatgcaactcccccagttttgtcattttttaaaaaattttgatttgcatttttgtgtagagatttaaaaaatattttatgtagttaatataacacccttaaaatgttcaatattctatgtgtgattttttaaaaatatatattccccatttagggttgattattgtttatgttagatataccatattgataacatataatgcatattcctcaaaatagtaattctaaggttaggataagaacaaatcagaaactggatgcagggaggcttttcaaattaaatcagcctctcccaagattctgaaggataccttcttgaaggcgagatcccacagattgtaaaccaatgtagggcagtactggatgttactcaaaaggcatgtcatacatggtagtgatgtatagggagaagaaaatcagaaaactgttgagcaattgttatttatttttatatatcaaatttgtcacaaactaagggaagagttaactatgttaactatgcatgcagttttgtcaatttctctgagatttttttgtttgaattttttgagtttttattacttttacacttattatttatgttttaaccttcaaagtctcattgctttaggtacagtcatgcattgctaaaggatggatatgttctgagaaatgtgtcattaggagatttcatcaccttgcaatgtgcttacataaacctagatgacatagcctactccacacctaggctagatggtgtagcctattgttcctgggctgcaaacctgcacagcatgttactctattgaatagtgtagggaactataactcaatggtaagtatttgtgtatctaaacagatcaaaacacagaaaaggtatagtaaaaacactgcatggtaatcttatgggaccaccatcctatatgttgtctgttgttgaccaaaacattatgtagcacatgaccacatggcagcaacttggctaacatcctttaattcaacattgttttcttataagtttgatgagaaaattaaaaaaaaaaaaacaatccctagcaagggccactctctgcatggaattttcacattttccccatgtttttgtgggttttctctgggtactccagtttcctctcacatcccaaaggttttccccttacatgaattgagttgtctacgtgaccccagagtgagtgagtgcaggtgtgtatgagtatgccctgtgatggtatggtggcctgtccagggctgattcctaccttgagccctgagctgccaggatgggctccagccacccacaaccctaaagtggaataagcagattggaaaataaatgaatgagtaaatagaaatcattataaaataaaaattcataaagtctatgataatcatacagatgcacagcaataaacaattcagtatgacagggctcagcaagctgcccagtctgtgattgctggggtttgaacttcatgctggtaggcggtgctccttacaatgttcacttggaaagcatttattccttgatttatataccacaccactgtcactcactgattcaccaaaacttgagtaaatcattatttcgttttgattaatcttttgtaaatgcatgtatagcacacattcatttcaatgtttaatattagtagtctatagaaatttggtgatgttttgtgaccagaaatatgccataggatcttaattcttttttacatcaattagcctgtgggaaaattgggtttgttgtatatcatttcacttaaaagtgatagtttacaaaaaattccaatgacattaagtgaagacttctatatatctctgcagttttagttttatctttcacttgagattctctgtatttaagtacgggagtcactcattcatacttgtttttataattgatataattggtcttctctctgccatcatgttttatgctttccagttttattatttcttgttttttagtgattttttcactacatttcttgccaatgtgtactatgaattctttgattttttttctttcaaggagtttgcttctctcaatgctaaattgagtcatcaaggacataggtagaaggtaatcttaaagactaagaagaactccagtattgccaggtggacttttcattgtgaagactcaggataatgaggagggaatgtgaattgagagtcaccaaagccagcttggataattatcaaagtcagagaatttcccagtaaacaaaaggaatactaggaagtgagatggaaggagctgataaagcagagagccagaaagctggatttggtggagacgttaggggtgcagagattgttttgaggcagctgttttgccagttggttgagaaaccaaggtaccaaaagagagaaaaatcggtgaagcctatataaacagttttgctattgagcagttttgctactgatcttgaaaataacccttatttagcatttctgaggtgacttttgttgagattttaatatttaagttaattttggttgttagagtcatatttaaataaaataattctgacactgaatgtacaaggcaatttcgctttattagttagcgtagggttctttaccaattaagtttaaaaaatgctaatcagaaaatgtgctgttttatttcattaattttttgttgtataataagctcttttattcttcagatttgggtctttcttcagcttggaaaatttgccattgtgtttatgatcattacttctggtgagaaatagcaattttcaatattgtatatttcttcctaggttgtcttcctcattttagtagttcagaacacggcttgtagagtcaaatcaatctaaggtcaaattccgcctatgccactttttagctgtgtgatctcagacaaatttaaaaacatatccttacattggagtttcctcattcataaattggggatgaaaaccttatttatattatggaactgctataaagattaaaatgagttatgtaaaatattttgctcagaaacaggcacatagtgagtgttcaatgaattcatagttacctttataatctctgaattacagtttctgatttctgggttattgtcccataattgtttttatttccattttctgatttttgcactgttgattctgctctttgaaacttctaagatgatttttaattcttctagttcagtctttgatatgatctgcctttttcctcatctagcttgctttgatttctgcctgcctcttgaaattctcaatttttgtcttcatctcttgtttactgcttaccttctgtctcttacttagtggattccaagttattttagatctaattaatggcatgcaactcgtgatttttaaattttacaagtttcttgaattaaatcctccccagaatatgacaatcttccataatttgagggctatatccttatccttctttcaagttacaatttttccatcagctaaatgtcctcccccaaactcaactccatagtttagttggctcatctctaatataaccttctgactgggtgtttgcatgggaaaattaaactgttttcaaatcatcttactgggcatccagttgctgttaataaaagcctttgctaagatgatgacagggttagtggggtaagtttgcattagccgcgcagccaccctacagtttcagcttctttcttcccagtgtttggtagagtaggagtgctgagagcttgctggcattttgcttccagtttaagtttgggtttgcctaggactttccttctaacagtccattgtctctgcctggtctcgttttaggtatttataaaactttggtcgtttcactgggattcttacaaggtggtagttcaaaactatagctgtatactgagtcaactggggagctttaaaaaatatactgatggctgtgtgccccacatgcaaaatgtctgattaaattggcctggaatgtggcctggacatttgtacttttaaattatctcaggtaattctgctgtacagccagcacagggaaactctatttaaaggaggagtttgtcaccagtgatcacatttaaattttatccagatattcttataactttcatttccccactgaaactcaaaaatgttaggaaataaaaaactaaatgtatataaaaaataataagctattaaaagtaaatagaaaatactagcaaaggaatatcataagatgacaaaaattaagtgtaatagttattgggaagtgggattttatgttcagacttacaaaaagcagaaggtaaaagcaaagaaaattattaaaaatgaatatcaactaagataactgaagaaaacagaatagtgaagcagaatatttaccattcatgaatttgtctatcagaggattaaatgagataaatcccagttgcaatggagagtccaagggttaacaggcccgctcaggagcaaatgggcccctttgggccacagggtctagattctgtgccctcccaaggccaaggttcagagcaaggagttctttaaggttcattccctcagccagagcctcagggtagaaaacccttcagttatcactcctgtgtatctttagatttgttgaaagggctccaattaactctgggtagcttttgctgatttttcctgcagccctgttaacatgcaaagctgcagcccagagagacaggactggcgtttcccctcaaactgaggactgctcagaaactgacttcataatttgatttgaaattatttcaagaatgaatggattcaagacttcgcacatatacgaattattttttccgtaaggtgtttaaacatgtaaacttaattatcagcataattactacagcacctggcatcaagtgttacagatataattggtgtatacaaaatattttctcaattttattgttgcattacattgagctaaagtctaggggttatattgcttcttcaggtaaaatgataaataatagtaatatttcttactatttgctatagtttggcaaatgaatcaataatgataagaataatcttccagatgactcacatatatctacatttatgtaaagaaaaagacattttaatttataacacaaataataatatagcttttgccactaaaattgtttcagtctttacatacaatggacttaatttttttacctgaatgaagtgggtttcatactgaaaatctgcctctaatttttgcctcttttacatggctactgtaataattagtgactctcaattctactggtcataaggtgattctcagattacttataaaatgcagatttgggggtcactcacacatgattctgtacatctgggctagtatttagcaatttgcattttacctaatgctccaattgtatttttggaaggtttatgaaccacatattgaaagacactagtgtagaggagtggtcagcttagactggaatactttcacctgctaggcttgcaactatccctgctttattcctgcttctggttctgactgtgttagctttgctgccagaaaaatgccaaggcaagtgaagaaagagaggcagtgtcagtaggacccctgaaccccagtaggactcctgaacttctgaaaattcccagaagaaagaaagtaagaattggggatcttgataacatggattctgattcactaggtctgggaatatggtgttagattctgcatttccaaccagccccctcccactctgtcatgccccatatagaaaggcaaggagctcactatttatatgggaaatggaaaacaacaacaacaacaacaaagaaaaaacagtaaaataaaacaaaacccaattctcaattacaagatgccccttaggttcatataaaagtgagagcagtataattcaatgtaggaattatcattgcaatgtcttggtagagccttgcctgcatgcatttaagttacaaacattcaactacatattttggaaatgggtaagggatggaggaaaaagtaaaaaagcaaaaattaaacaaaacaaaaacctataaaaatagtgtcataggcaaaggatgctatccagtatggaaaatgtcaacatctgttagctggaaagaatgtttgaataattttagggtttcccagtcattgacaaagaagtgatactcattgtttgggtgtctacaaaaagaatgaagacttcagagccctgaagaatcattgatttctgaagagttagaggcatacacaaaaccaaatgtactatactttatgggccatataaagagttgtcaagggaactttaaatcacgttatttttgccttatgcctgattttggaacttaaactcagctatgcagagtatcatcagtaagattaaattaaattaaaatgctactctatatatgtatgtatatgtgtatgttatgtacgttcatatattatataaatatgctctctctctatatatgtattctctctatatatatgtaaccatacttacctgagaagtctgcagagaaatgactgtaattcaacgccgtgaaatttttttttctattcaactgaaagttcttactccatagttgctaaaactgcctatggtactctctgtgcacccatgctatttcttcaatagacaataagctcctggaggacaagtttcatgtttcatatttattttaagcctcgttcactaccttgctcaaggtaagtgattaatatacttatcttaaaagaatgaatgaaggaatctttcaattagcaaatgtagctttctgctactaaccccatagttaacctaatgttaatatttttttgtgctgagttggactgagtattgaactactagtccttactaaagtctcctcagtcttttatcaacagttctttaattttatagaagaatgcacagagctatcacaacttaaatgtatatttggaacttaatacacatttcccaatagaaaaaaaatatgttggtagggtaagactaataaataactaataaagactaattccaaaacttagacctcagaatagaacccaaccactacatatttgaaatgaaaaataatggaagccaatactgctgcaatgctgataattataaagaacagaaaatattcatttatttaaaaaagtgatctaccacgttccatgctagtgctaggccctatcattgtaacatgatttttataacactaaaatatagcccaagcactctctctgaagtataagattatgtagacaatgaaagttttatagggaaaacctaacagagatgggtttatcatttttaattcattatttcacttgagatactgagaacctaaaataatagcgatgaagtttttctctcactggtaataggtgtccacagtaagtcaatgcagaggcgggatgttcataggcgagacccacacacttcatctttttgctgtgtcatccttatggacaaggcttctacctcatagttcaagatgactgcttgagctcctgccatccagtctgattttcacccaacaggaagaaataatggttaaagaatactcacattcactttaaagacatattttagaagttgttcctccacctctggttatcttgcgtggccagaacttagtcacatggctgtacctagcttcagggaatgttgaaaaatgctgtctttattccaagtagccacttgcccaggtaaaaagtgtttttattttactgaggaaaaggagtataatacataataaggagcaattagtaatctttgccacaataggaaatcgtcagaagtaaataaaaagtaattctttttgttggtgttattaaagataaaagccagtttttatagtagaccataaattaatattccaatatttgtagtttattacgaacttttttttttaatttgagatggaatcttgctctgttgccgaggctggagtgcattggcaccatctcagctcactgcaacctgcgccgcccgggttcaagcaattctcctgtctcagcttcccaagtagctgggactacaggtgcatgccaacacatctgttttttgttttttgttttttttgtttttgtttttgttgttggtatttttagtagagatgggatttcactatattggtcaggctgatctcaaactcctgacctcaggtgatccacctgcttcagcctcccaaagtgctggcattacaggctacaaaatatttctttaaatgtaaatcttgaaagaaactggtctgaaaaaattcacaggacgaaaatatggcctatgacataaatagtaaaaatagaaatgatgtaatgttcctgcttagctaatgtagaaagatttcattaggtaatgcagtgttgatgagttaatagctttgtctaactctcctgaatacataatgtgcctgaactactggtacattgtgaaatcttcagagagagttgttttttaaaaaaaaaagtttttcattttattttatgcaataagaattgacaccaaaggatttgcatttctttttggtaacatgttgagccgtagttaaaaatgatgaaaatatataacttttgttctacagtgataatcaactaggcatgtccacaatgcttataaacattcaatacaaatacttcaaggttatcaatcatagttgataaagaagaagaatgcacagccagacttttctgttttctaccttttatgatcattttatatttgtgttatatttggaacaaattaaaagggttatatgtataataaacaaaggtccaatattgaacccaatctctctctctcacacacacacacacacacacaaatgcacacatagaatttcttataaatcagtcatttttgtaaaggaatattacaggcatacaaacttgctcattttggaggacaagacttctaatttctgtttgtaagcaataggtgtcagtaataaatttgaacctcttaacacattttaaggtgcattttaaataagatattttatagtaaaaagtgtgctattattgtttttaattaccatttttcaacacttttttcttgtttgtggaactggagcttaggtcaaatgggaggagtaatgatcttggggtcagaatacaggttctaatattggctctactgctttttagctgtctggacttgagcaccatacagtacactcactccaaaagcagcctcctctgtacaatggaataacaatatcagaggcttgtagcaggggaccttggacactgatcataagggatgactttcatttctctttcttttcttttcctcttgtctccttgcctgtctctctgcttagtcaggtccagtgttttcttgaagagtttcagtaatttcagtgtgagacctttatgtaaggtaaagagttaacacaagcacgtggcttcaaacttattggcaaattagaataaaaatggcaaagactctgtagttcttaccacaaaggcattgattaaaaatttgaggttagaggtaaacctgctgagagaatcttaactggataatactttgaggtcaattaaaatcactgtttaaaccgtcctctaagactgggattagaccacatattttataaagaaataaagaataatgtttttcctgtttgtaagaatcaacatctgcatagtctttgataggtatatgatattctatgctctctaccaaaagttttaaacaaggtcaaaaaacccatttgaaggaaattaaatgtaagaaaaattagttttgaagtttccaagggattaccttaggtttgggttaagtgtatttattgttccaccttttgggtaaaatgcaaattgactttccctttgtaaatattagaagtccttatttttattgaaaatattatccaaaaacaacaataacaaatcccaccctcctgggctaagaaccagaggagaagcatcctggatatgtttccagatctctattagatagttaagttttcatccatatttaacaaatgtcattattcagtttcatgggatcactgtgtcaaaatgtctgtgttagaactttattttcagaggttcctttaagtggtcaggaagcatggcatattggattgattactctctttaatccatccactgggttggtttgggatgtatacttaaaaattagattttatcagcactgcagcgggatcctcagccagaagtctcttcttctgccctccttcccctagccagttttcttttaaaaagtgggctcttccattatgtctccaggtagcagtagcagctctgcctgtgtggcatcccttaccagatggccctcttaataaatgtcttgctcttgcccaccctcactttcttgatccaaatgtgaaatgccagcaaataaataagagcattgtactctgatgagttctcttgagatgggggaaaaccctggggagaggaagctagaaacagcttttctgtttgctgtgactgctcctaattactggccagtagtagaagatatcatttagatgcagtagaatataaagataaagaaaaaaaaatgagagataaattctccatgttatcccaaatgcctttgctaacgtggaaatactcttggattgttggagtgcatttgaaatattgtgcatgatccttacaaggggacccctgactttggactcagggtagacagttgctgcatgcagatttcaccgccagactaaaagtgcaacggaaatgagtgggtgatgagagcagagcagccagttctttaattgaattaaaagctgggtgacatcaatgcagacacctgtccaattacagacaggccaaggtgtttaccattgctgtacaagcgattcgaagatgacagaaatctttccgcccacagattaacataatgaaggagaacagattacagtggatgccggccaaacaccttggttggcagctgggggtggggtgggggagggaggaggagtctgctgaagtatgtaagtagaaacggagtccttttttcttctctgaaatatgctcggctttaaaaaggatccattttgctttgtgtcttaggctcggtttccaggcagagcatttatacttgtctgcatttagtcagaggagttaatcataaaatttcaacgtgaaagcagactcctctgttgttttgctgcttctcagcatacggtgtcccattagaggtgcaaaagcttgcagagctggtgtcagctccacaatgattttgtcttaggtcgtcaggctgcctccaattattaatatttttctttggctcctttgaaacttgaggttacagcaaaggaaagagagtgttggagataataatgtatcagtcaaaagaaacaatgtctgtcactttgcttgttccctggaaggggcgtggtgggagtcaggctctcctatagtgagagaaatagccgagtggagctaacagtctgcaaaatcttaattttcagtcacccgtcaagtgctaacttttggtaaaccatactaatagctgctgggatagaggataaggaaagcagtaaaaggctatgccctctgtgttcaaggaattcccaaatcactgtgaaggacttctaagttgcaagttctctaggccaatgctcttcccctctgttaagtggaaaccctgagtgcacagagtttggagccatatgcagtaggcctcttaacctatctacggtgatgagtttccttcccttaaatcaagtccctgccccctgatctttcagcttgggctttctgcacccactgtggcccacaggacttcaattcaaagggaatctacttacttgacttcaaactcccttggtgtggcatgtcaggatttctcaatgttaggcattaatgcaaaatgcattatcgcttagcagtgagagttatggtcctgctggtgccaatgattttaatccggatacccacgctcctgtgtttcatgggatactaacacttttaagacatcaataatgcttactttatgcttattgaatgtttcttcagcttgccctcttccattacctagagggactagcaggtttcctgacatgattgggaccattttctgatttcacagagtttgtggctgaaaggcagtttgcgaggtcatctggcctgccttgtaatagggacactctcaaaaaaaaaaaaaaaaaaaagacttctctgggatgtgtcccaaacaaagagattcacaaccaaaccaattttaaagttctccctttcaggatatacttcttcagtataaaaaccccaagtgtcacaagtatcataaaaggcaactaccgcattttctatttttgggctttctgtctaggattcctttagatatgtcaattctctatttcccagtattctttttaatataataccaaaatatatatttaaattaaatttaggcttcctattatcttgaactggtaagtctgaatcttataaatgtcattgtctacttggcccgtatgcaaacattcttctttatgtatcaatctgttactgtaagaattcttctagttccaatattttcttatgttagaaaccttgtaaaaatcagttgtattctatagcaccttttccagacgcatatagcggaaacattgataaatgctttttgatgatgatatatcttcagagtaacactgtattttccagagagtacctaatctaagtagaaccctgacacttaaagcaaagccattaggataaccactcaatgatctcaaaggatatatccacaatctacatagtcttggagagaatgtgttactctctttctttggccatggcacaacttttcaacttgaatccatcctggtgaacactacttactgagaatcaaaggagataaaccacgtgtctccaacaataaaatgaccttgtcttgattccaagtgaatgaagaccacatatttgaccagccccttgcccttgcataacccttaatttttaacctgacaggaggagaaagcacagtgaaccattatagtgttcttcttcctgaagtaggtaattctaactgcctttaaggaaaattatcagttggtttgacaaactttgtctctgacacacagcatgatgaacaagattccctactggaaatagaaaagaaatggcactccagccttagaaaatgcagcacattttttgaaagtgtgatttacaagccatctaaaaccttccatctttgatccaaagttggcaagaaccaaaacatcagctttcttctttttctttctttttttttttttttcctttgttttctatttttcagctctcatttctcagggcttattattgtttcaccgggcttgaaatgggaaatgtgagcactttgataaatggcttgaaagatgatctagtttctctccagcatctttctttaagagtctcagggtttttctatgaaatacaatacaatttggtaaagatctctaccaaatcaaagctgaagaagcaagtttgctgagatgagcagtgcttgcttttaaggtccttaaaataaggagtggctaaaattaataaaagactctcactatacacatgttatacacaacgtaactcctttagtgaagacaagaaacattaaataaaacactaaagatcacttagtgagttgtgaactcaggatctggtttgatacaatccctctgaaagtctatagaatacccttccttataacttgatgtaacaattaaaatttcaacatttcactctagttatgatttggaaagaaatgtcttagtataaggaattttataaagccaggctgtaaaattgtacaatcatagagctgcttttatatttctcaatgataatacttcctgaatgtacaacacatcttcatgctaatgattgcagataaccaacctgtatatcagcattgtttctttttgggcatggtgttcctatgcctcagctgaagcatgctcatctatgaagggtgctgcttttcacatatgccccataggttaagtgatgataaagggaaactagcctcatattccaacatgcttttccttattgacattaggattaaaagtcttattctctgggggctgattcatttcttgttagcatggcgttatactaattcagccatgcaagtcatcttatttagaatcttacggtagtttccaacttggcaataggaaagacatggcaaatgccaaagatttgctaaagatagaatggctaaaacacattttatgatgataactttagttttgagcctggaatttgggtatcgtggtggaggcattacaaaatggaaaaatgaagcttacataattatttagaatgttgattcttggttggggcacgttgagtatgaaataccagtgggacatccaggtgtggttacatggcctgcagatagaaacccagaaccagggcttgggagagatgtgaagtctgtagatacaaatgtgatcactgaaagataaggcttaataagctagcaaaggcgagtgtttagaaaaagaaagaagcttgacaacaacccaatcttgagaaacaaaagctatttaagagactgtgagaggaacatgagtcagtaaaggaaacaaaggagttctcggtagtttaggagaacaactaaaaagttcaatgtcacagaaggaagttgagggaggataaggactgaggaagggctatttgatttggtatttaagggatcactgctgatctttaaaagatacaaagcgtcggccggccgggcacagtggctcacgcctgtaatcccagcactttgggaggccgaggcgggtggatcacgaggtcaggagatcgagaccatcctggctaacacggtgaaaccccatctctactaaaaatacaaaaaaattagccgggcgtggtggcgggcgcctgtagtcccagctactgtggaggctgaggcaggagaatggctccaacccgggaggcagagcttgcagtgagccgagatcgcaccacagcactccagcctgggcaactgagcgagactctgtctcaaaaaaaaaaaaaaaaaagaaagaaagaaagaaagaaagaaagaaagaaagaaagaaagaaaaagatacaaattgtctagtagcatgtagaggcagaaactgagttgcaatggtagcctaaattggaatggcatagctctgcactagagctcttgactggcaatactccatgtaagtattctaaagtcctgaacttgttcagtcttaatactaaccctttgaggtaagtactatattatccccatctcacatgtgaggcctgcaaggcctttccttcaagaccgagattattattatctgtttacagactaggaaactaaggcacagaagtctgaacaacttgcccatgtacatatggccaatcggcagcagatttggcatttggagccagcaatctggcttgagcatgggtgcccatttccccactactccattatgaagatgtgcatgtgataatgttagcttgcttttaagccatttggtggaaggagaaataacttcttaaaagaaagtaaactcagaacgtaggtcatgatctgggagatttaacaggaaatgacaatcgcaggggcaggaatgagagaaagcaggaggttctgacacgagagggttttgaaattagagagagctgaatttggcatgagatggtcacacatgtgtgtatattagttcgttggcttgctgtcttctttggccatgagctaagatgacggtgccaagtggatgaatattttcatgtagaagcatggcagacaggattcagtagcccacggagatgcctgggtcgttgctggaatgaagacttagagacagccctaggaactaagggcaagtgggaggtgtcaaagcaaagaactggtctttgctccatcctggcttgttgatcttttaattctttaaattttctactggggagggaaattatggaaacatgtatattaaaatttgtgtttgaatgatgaaagctgtcatcaaaattggcaccttaaagcaataatgtattctctgagcgattgaaggtttcatcaataaagagacaccacgagtggggccatctttttataaaaatagtcataatctatgtggttaggattaaagattgctctgaaaaacgtctttgcggaaaaacagtggtgagcaaaagcacaagttatattttggattttttttaattcacaggattaactaaataaggagtctctgccttgcttatgaacactagtaaacaaaatgtgttttcatttctacacatacttttaattgctgaacaaatctcatatatctaccagcaagccatgttaattcaatacttccacgtgtaacacttccgtttaagacaggtgtcttaattaaataaactaataattttgcaagtagaagtacaaaagcataattatctaatttgctaattgttcaactatgttaatttgcatacttgttagctacaacataaacaaatggtttgtatatgtatcgcctactgttaaaataatgaagccactcttgggagtagcatttttaaagtgtgttaataggtgccctataaaaaggactccttagttaaatacggttgaaaaatgctaggttaaagaaaattaaatagttttgtttctgcaggaggtctaggatcctggaatgagataatatatatcttagctattggaaacattgtgctctgcctcacgaactatatgtggaaccccctccccattttaatgggagaaacatcagatgctgtttgagagctgttttaacaataagttggtctcacaattttttctcatgagtccttccattcaacaatcagcagaaagggaggaaaatgactgaaagaggaatatgtttttgatttctgtctctggtctctttgtttttgtctctctctcttatagacacacacacagatatacacacaatgctctttattgatgcttatggtaaacacgcaaccctcttttgtccctttttattataggcatattgacaggcttgctacccttcaaaaactatgcagtaaccctaactgcttgcactttggctggctgtactgagagctcacatgcattgaacatctctactccacaagaaggtaaagtaatttcaaaggtcttgacttccacatttcagtcatgaataataaaataggagaagagctaaatgctacaaggccatttgctggcaaaccccaacctaatttgatgacaaagtgcattgccaggccataattgctccattttttgggggggtgcgaaaatgaatcaaactccataccctttaatgacatgcatctttaatagctgtaatgcagattaatgggctttttaattgctgttacattgttcatgcaagagccttgtcattaatatgaagcatctgaaagattaatgaaagcttcctcattttactatggctcagaagtaaatctagagacagtctgactaaaaagaattgattgtatggcacagtatgaaattgagaatcaaacggttgatttccatggtcttttttaactgctaaacagcagcacaggcaacaattatttcagtatgatgaaacctccaaatgccaattgaggcattattaatcactgcttagttccttccaacttaagtctcacttctgttgtacttggaacttacaaactgttggcataaattaaggtttcagaaagcatatgttaagaaggcagtgagaaagagaaaatattttagcacgccaaagtgaaagctttgctcaagcatcagaatgcatcacttcaagaaataacagctctcaaaacatttgaagcattgttacttcatatttctctattctggataagaggaattgtacatatcttatactgtctagttgaaaagttctttaggagatttaaacgcttgatctttagggaaaaagagtcagccagtctttctctctctctctttcccagtatctatatattccccccttcctcttttaaaccctttaccaagcaccacttgcactgaagatatgtaacagaaaggaagacatggacccataggatgaaaccaggacaggataaatgactttgtaaaatccttcttgtgacccttaatatgctgtattttttacctaaaccaatcagactcccctcacctgaactatgctgtcagtgacccagcctcagcattttctccatctggtctactggtaatagcactgtttttgttgtatcattgcatctgctgaggacatgattatcatcccctcttacaaggactttgaccagcctcaatatgggacaaatggccctatgttgcattattttctccgtatccactaaatcctttgtccagggtttacctggtacccttcataccaatttcaagctaagccccagagagatccctgctcttgtttatatttccttttttatttttaaagacattcccaaacttctaaatatccacgaagtaattctgaatttactaaatgatagaggagtttaggaaaatttaaaaaaaatgtttagttcttaggaccccccaattcattgacaactatataaaatacacagctctttttaaaaaaatatgcactaaagttttcatatgtaattgactaatttggttatgcgagctctggcaattcttatcattacatataggtttttaaaaatttatattatgaaccacattcaccagcattactcatctcagatcacaagctccttgaggctaggggactctatctgcttaatttgctttaataggtacagtcccacatagagattatgggttaatagtacttttggtggagtaacacaagcatcagtcaagtgaactagtgtaagtactcctcatccatcattgacacaaattctcataaatgtgggacagttatttaacactgttcctaaagcaattactgacaagctgcccacgaatcgggaatatttccatgcatgggatttcaggtttattccatgatttattggtttgggtctgaaaagtttgaattagaaaagtaaactaaaattagactctataaatcttttcttccacagccccacaagaggttcagccaccagtagccaaatcccttcccagttctttgctgctctcctggaacccacccaaaaaggcaaatggtattataactcagtactgtttatacatggatgggaggctgatctattcaggcagtgaggagaactacatagtcacaggtaagacctctagagttatcagcgaattgttatagtctatattcaaatataaacatacatatagttggctctcgatatccaggggttccatatctgcaaatttaatcaagaatgcttaggaaatatgtgaaaaaaataacaacagaacaattaaaaataatataaattctaaaaacatagtataacaactatttacatagcatttacattgtattaggtattctaaggaatctagagatgatttaaagcatacaggaggatgtggatagcctatatgcaaataatacaccacattgtaacagggacttgagcatccatgaattttggtatcagtagagggtcctggaaccaatctctcactgatattgaggagtgactgcacacacacacacacacacacacacacacacacacacacacacaccagataaatagagtctatagttatctgaaaatgtgtttttgaaattgggttgcttatttttatctcctgttaatcactccaattgtatgatcttgaaggtcatattagattcatggtgaaactgaagctaaaaaaatatggaaaagtgctcatgttacctccctccacccagggctgtcctactgtgtgttctcttctatagagcccaccaccccttacctaaatccttctagcaattacctttgctcagatgcagaggaggcctggaaatgcacaaatgtgctaagcacaaagagctcagcacatgacttctctgacttcagcagaccacaaggattgaaattgggagccagtgttttcccagtcaggctcacagtgtccagttggatcaatgacatcatcaaataaatgcctctctcacatgagctattagagtggtgcaaaagtagttgtggtttttgccattgacagtaattacttctgtaccacacgaatactttaaaatcctcactaatgtgtaatagtcttaagactcagaagtgtgactcagtgtggtttgaattttagatcttagaggaaacatagtatatctgcccatatcatattataaagtgtgatgatactgaaattaaatgaagtaaattcttgaaaaactttctaaatacagaagacttgcattatgtatgctgcctgtactgtgtttatatttgtattatacttatagtggttttgtatttcatattattttatatactgtatgtgactctcatgtgagacattattaatcaaatgttgactgatgaaaaaaccaaggcctagagatattaacttcttcataaaggtcataacaagttagagtcagaggtaggatgaattatttatgtattcactcactcacattaatgccaggtactaaggttgtaatagggaactggccagatactgtccctcttctcttggtgctcacagcttcatgggggcacatgtagatgctggagcaagtcgtgtggacagggctgtgtattcatccagttgcattctcaggtttacatttttttggcccccctctagtctgagaaccttaaaaggacaagaacaattacttttatattttattattcataattggatagaattccataatatttattctacaacataggtattattttacaccccaattttacaagtgaagaaactgagggaaagaaggattaagtaacccaaggtcacacagcttgagtcggaggctttggtactaacccaagcattccggctgtgttgaagaatgtggtcttaaaaacaagtgttttaacttgtcttagtttctgaatttgtaaaatggtgttaattacattttccagtattttaaagagaattagaactatatataaaatataacatgtcattagcaattggtaaagagaagttataattgttatctcctgtacaacacagagttcattgtaaaaactgaataggttaatcttactccaacagtatcttatggcatgattttaactaaaaattataaaccacagaagttatttcagaaaaaattaaatcacaccatggaaggaactttacatatattacatctttgaacctttacatatattacatttttacatatattacatctttgatgtaacatattaataattaacatacaaagcacttctgtgaccaagaggtaacattgcatgtaatgggatatcataacttttagaaccagaatagacatgtcctctgagaatccttttgctccccacgtgtgacacaggtatgccccgtatgcttactgattacctttatattacatcgctgctttttgtttgtgtcatcttgaataggactgtttgtttgttcatcggtttgccctgctgaaccataatgatcattaaggacacaactatatttgtttttttcattactgcatctcttggacctatcacagagtgggaatggaataaaaagtgttagagtgaaagaatgaagtcagatgattcctgggaataaaaacaagaagatagcaaaggggaactgatggaggataggattagggtaggaataaggcaatagagaagagagaaaaatggaaaagatacagccaggggaagagaaactaagaccccttccatgcgcctaaacgaaagctgcatcagtccacagggaagtggtgcagctaatggcaggtctcaaactgtgggccttgactctttccaaaatgtacagaactccatatgaggttacactggacaaaaccggaaaaagggcagtgtagggagaggaggaagaattcacatcaatttctaataccacctgcaaaatgacactgaattctgtattttgtttgtttgaattatcaagaacgccatgtgactataggccctgaagaaagattgtggtaaatggcaccatagtgtattattacaatagaagccccaaatataaagaaagtgaaatatttttaaagtgcctacatccatggtaatagattgattcttcaatggttttctatctttatgtaatattttaaagaatatatctccaatactacccatagcatttttttttctgctgtagctttcttggcatttcataagcaactatgttccttgttgctttcatctccaaatagtttaagatatgaagcatattgggactgcaatgctggtcaaggaggggaaataaactgagaaagttaatatggggttcaaagatgcacatgattattctaactttatagctagaaaaactgagacctagatgggttaagaaactctagtcagtaatcagaggaactaattcaaatgtagatctgtctggccccaaatcctctgcttttaatttctatacattctgcttgttgctcatattttattttcccttgccagaactctaaaagaaagaccccagaacacctgtattagtctgctagggctgccatgtcaaaataacaaaactgggtgactttaatagaaaagtatttctcacagtctggaggctgaaagtccgagaccaagatgttggcaagcttgatttgtcctgagtctctttccgtggcttgcagatagtggcctcctcactgtaggtgcacatggactttctttcaggtgacttcatccttggtattttttcctcttcctctgaggatgccagtcctattggatgaggttcccactcttacgaccacagattttatatcagtgatatggactaagttcaggtcatttatatttttaaagtttagctatctacagagactctcagagaagactaaataggaaagggactctgtctgtctgaagtcagcaagggagaaggctgtggagaaactgatctagccattgggatgggctttagcttctatgggcagtttaagtctacaccataacatgtatctatctacaatgctattggtacttactgcttgtctttgtgtcagggtatttgtgacatagtatcttttccacactgagtggcttgtgggtagaacttctattcatgatgtctggtgatttcaataatagtgtcagtttaggtctactaaagtggatctgtatagagctgaaatatctcttcatagagaaaccgagaagtggaatacagagtttactagatagggaaaataattgataatatctttaattataaaagtgataaattcttacagaagataatttaaaacatgcagacaagtaatacctgagaatcctgtcatattgaaactcataatatttgatggaattccttctactactttattcatgttaacaaaattgagctataacctatgtatgatattgaatacatattcccttattatattatgactatatcctatcattaaacatttttgtaaaaatattttgaaatgttttgaataacattatattccatctcatatagcatataatggatatttattaatgcatttaaccatttgagcaatagtatctaatctatctctattttaaatatcttgacatagatattcttatacataaatctttatttgctaggttcctagaagaatagctaaatcaaaggtaatgaacatttgcagaatgtttggtatagtttgtcacattattccaggaaagttgtcagcagtgaattttatattcttaaatatttgattattttacaaaaaaaaaagttattttattttaatttgcattttaaagtactagttatagtgaatacttttctgaataattattaaccttttatattttcctttcattcatctaatcacattcttgatgagcaaaaatttaattggggtaaggaataattttgagacttctccacgagctatcctgttttttctggttacaatcacccacactgtttaaaatgttttaccctctacaatatcagaaacttccctactaacttggtttaatgtcccctcctaaatattcaaagtgtcaacaatttttttctcactcctacttcatttacttgtagtttccctttaggtttccatatagaatcgacattcttcccgtagggtttgccagtggatcttgctgccatggggggcacaagcaaagtaaatgcatttcaattcagaagccacttagcatccaggtggcttggatttttttttcttctttttcttaaatatgaagcattaaaagtcaaaggcattgctgcaccttgagttagtacaaaatttattttaaaatgcatacagttcaaattttttaccttgcataggccataagctagtagtatggtgggtcagttctgacactgaaaaatgaatccagttagagaacctcccgaaggctgttgatgtttgctataataaatagcacacactttaagtcaaactttttcattctgtattcaaaggtaatggatttttcgtaaccatagtaaccttggtgtattctggataaatacgtgaggtatatacattctagttttatttttgaatataaactaccacattatgtattactaataatatgaaaaataggatgtaggttagtataatgacagcttaaactagtatgcattttccttctgcaaaaaataaatatttatcaaaagtataggttcaattaatttttctcccagttttgtggtattctggtggtgccatttatctttttttccaagatctccattaatctcttatttctgtcccataacagatttttaagaattttgaggtaaaaacaattgtactttaaagcttatgattaaaaacataatcgaaagattgaaggacctatattgatatcactagcagagctattgtgggccacttaagatgtgtgtatacagtacattcccaaacaagtagacaaaagaaatccttcatgagactgttcaacataccaggattgtttcaaagttcaggctggacagcacctgatcgatgatgactatccagactgtagccacagattattcttattttaaacgagcaccctaccagaaactggccgtttttaagaagtttataagatgtttccaaaaagcctacaaactttttagaaacaaaaatagcaagatggtgctaatcaggacaagtctccaccaaacccggcaaggaggtttatgcgagttgtgcttcctagttagaaaatactacctgaattgcttttggttaagccaacctaagccattgctgtggataatgactagaactccaaaagaggaaaggttaatagggacattatagaaaaataacaactatctcacaccaagccataacacgtgtgttttcaaatgtatcatctgataaatctacatagtcatcttatagttaaataagagtgactgatatctagaaccatagatagtgtcttcccactgctgttccatcaggacctggatttctatcactaagactgaggcagtaagatatagataatagcaatgtaatgagtgtgtgcatgcgtgtgtgtgtgtgtgtgtgtgtgtgtgtgtgtgtgtaattgagagacagaaaaataaagagagggtagaaaggcagatgtgggcagggggaaagagggaggaaaagtggatgaattctggtaaaatcatataggcaataattatttatgtctaaccaactaaaagtgctaaaactttttttttggtcttatttgccaaggtcaaagagaactatgtgtaaatagcaaaatagaaatgctcatcttaaactttccaaacacttaagtcttacgatgggaaatttattgacgaagaagctgtattgcttatggcacaataaaaacacatttaaaggttaggcacttctatccgagcgttataaggaaccttatcagcactctacaaatttgagctaaattatactcattcacaccaatggcttacagaagctcttttcttagcaaaatagaattttactttaacctagatattttctttattttgcatatttaaatatcacattgcagtacattgaaataactcctcttacataaaaatactattacctaaaggaatgctgttaacacgcctgtgttctgttacaagctctaatattaataaagcagagcatgtgaggatttccaggtaagatgacggtctcatccatgagtcaccatgccactctattacaaacgaggtcataccatgtttccctttgatgtctcagtcatatagtattaaattgtacaaagtctgagaaactttaaggacacgaaggaacaaaagtcaagctatgcaataagtagagccttcaaagccaaattactaagctactaactctgtgaccagagactccagaatagttgttcaaggttgttctatataccagatctttgggttaatgaacagtggatgctatactctcaagagtcttattcatcgagcaacaaagggtcaaatgaaatgaaataacttgtacagaatgtttgaatatcagttgtggttagctgtaaacaatacaacctaagtgtcgttcttccattaaggtgcttctataatgcacccgtatgtgaagaaataaaatatgtttaaatttacattttaagacccgtacccaaatattatatgatctgttaacctaattaaggaatattatgttcgtaaatgatagggaaagattctatgcttaaagggattttagaagaatcatgggaataatattcagttagaaaagcaatggagttaaatgctggaaagataacggaatatgtccttcagttgaaagtgttacaaatagaggtgtcctgttattttcagcattttgagagttgctatgattttttatgtacgttttaaagtgcttaaattgagttataaattaatacagaaaagtggacacatcttaagggtacagcttgatggatatttacaaaggaaacacatctatggaatctgtacccaaaacaagaaacagaacattgtcagcaccctgtaaagctcctcattttgtggcctcaaatcttgactcaggtgattgctttcctgagtgttgacaccataaactgattttgctaattttgtactcaatataaatagaataagaaagtggagggggggtcttcaaaaagcttatggaaaatgcatattatgaaaaatgtgaggatttcaattttttccaccaaaataaactcatactaacttgttataacattcctgaaccagatctagtttgaggtggtaagaaagttaagacatcagtctgaaacaagcccctaccagggcaacatgaattcagtaaaattgaagcaaggacaaatatcaaatttctggtgaagcttgcatagaagaatagtgaaatcattgatgttttacaaaaagtttttgaggacaatgccccaaagagatcggcagtttacaagtggataactcattttccttaaaggacaaggaacaagacagtattaaagatgaagcctgcagtggcagaccatccacatcaatttagaagggaaaatattcattttgtctgtttcctaattgaggaagacaaacaattaacaaccaacatcatacacatctcaattggttcactttgtacaattctgactgaaaaattaaagttgaggacattaaacttagcaagctaacataggaacggaaaaccaaataccacatgttctcacttataagtgagagctaaatgatgagactcatggacacatagaggggaactacacatactggggcttttcagaggtggagggtagcaggagggagaggattaggaaaaaaaaaaaactaatgggtactagacttaatacctgggtgatgaaataatctgtacaccaaacccccatgacacaaggttacctatgtaacaagcctgcccttgtacccctaaacttaaaataaaagttaaaaaaaagttgagtgaactttctacttagtgggtgccaaaactgttgcacccagatcagctacagacaagagcagagctttcaatggaaattttaaacaggtggaatcaatatcctgaaacattttatcaaataattgtaataggagttgaaatatggctttaccagtacaatcctgaaaacaaagaacaatcaaagcaatggctactaagaggtggaagtggttcactcaaagcaaaagtggaccagtcaagagcaaaggtcatggcaaaagttttttggggatgcttgaggcattttgcttgttggttttctggaggaccaaaaaacaataacatctgctaatgatgacagtgttttgagaatgttagccaaagctttagcattaaaatgcccaggacagcttcactagagtccttcttcaccatgatgatgcccctgctcattcctctcattgaacatgagaaattgtatgacagttttcacggaaaatcattaggatcttacagttctgatttggttccttctgacttcttttcgtttcctaatcttaaaaaaatctttaaggagcacccatttttcttcagttaataatgtaaaaaagactgcattgacatggttaaattcccagaacagtcagttattcagagatggactaagtggctggtatcatcacttacaaaaatgtcttgaccttgattgagcttatgttgagaaacaaaggttatatttttattttttaattccattttccatgaaatttttgtagttcccttatatgttctcttttgtcactgtctttttcttagagatataggagggagagtaaatcagtacaacaattttttgtgttcctgtacctacattcagaaccctctgatctacaggcaattgctaagatgttgttagttgttaaattcctgtcttccagaaagccattggaaaatttgcaaactgaaacatctacctctttctccaagttcagatctagaaaataattatagaaatgcttcatctgtgcaattagaatttagcacatgaagtcactgacccgtgtacactagcaacaaacaaaccatataaaccattctgagtttccaacaatgtaatgttgtgtgaccataaagtttatgatgctgtagaaaaatatttaatttggaaagataataacaacaaatattttacacatatttgagtctaattcgttaaaatatatgtgtatatacatagatacatatacatggatgtgtacatatacatatataggtatgtccccatatggacatataccaaaatactaatagtgattatctcttaataatgggagtctggtattgcttttttttcttttccttgagagtcgttcaatcttttaaattctctacagtttggatattagaagtcagattctttttgtaatgttattcccaattttaatatatgtgataaaattgatagaaaggaaagaaatttcgggaacctgactacacttaaccattaatacttatctctagttttccctagtcttcaccttatatttaatcaggttgatcgtcttactaatttccttctagccaataccatagatgacctctagcactatctaccaccatcaaaacgttatgtatatttgatgatctacctcaattcccacatcttcatttgactcatagactcttccatatcaaattcctacacatttgtcatttggacacattctatcttgcaatattgacttattttcaaaggagtaaatcttgattaaaaataagaatgtaagtgcattggttacagttattatgccattatttattttcaaaatttctgtaatatctcacataggaataaggacccaactggcatccaacaaactcactgaattgagtttaaatgaattaagttgaaaaaacactgagactcagtaaattaatattttagagaaaataacaataaataccaatgcataatttggatataattaacatgctaaacttggtaaacaattttattgaggtaggctttcctgtagcttaggatttttcatttaatcatccaatatatagcaaatatatacaaatatttgttgctcaattatgtgttttagcttgctaagactattgtaacaaagtaacacaaactagatggcttaaacaacagaaattgactgtctcacacttctagagacagggagtcccagatcaagatattggcaagactggtttcttctgaaggctatgaggaggaatctgtttcatccctctctccttgttttggttgtttgctggcgatatttggcatttcttgattgtatatgaatcatcccaatctctgccatcatcttcacataatgttttccctgtgtgcttatctgtgtacaaatttctcctttttataaggacactagtcatattggatttgggcccaccttgttgagctcatctgagctaattacaactgcagttctagaggctaggacttcaacatatgaattttggggagaacacaattcaacgtgtaactctagtgctgtgcatttgatgctgtgattaataacattctaaaactttcctgaaatacctaaaacatattagagaatttaaggtgtgtgttcacaatcagttttaagatggatatggcccatgacagtaatgaaaatatttagaaaaggtgataatcaattccatctggaatgctcccagccttactttttgcatcttcacaatcacatctcttacttccctggcttgctttctttgattctttataggagtgattagtttcctagtgctgcttaatacaatacccaaaatgggatgccttaacacaatagaaatgtattctcttgaagtttgagaggctagaagtttgaaatgaaggtatcagtaggcccattgtctctctgaaaactgtaggggagaatccttccttgcctatcccgccctccagtggtttctggcagtcagtggtattctgacagtcagtggtttctggcaggtgtctgtcagtcagtggtatcctggcagtcagtggcttgcagttgcgtcaccccaatctctgcttgtatcattacatagtgttttcccttcttctaaagttctctcctcctctaaggataacagtcatattcaatttagggctccccgtctttcagtatgacctcaacttaacttcatgacatctgcaaataccttattttcaaatgaggtgacattcacatgtacagggagttaaaacatggagataccttttgggaggacaaaattcaatccactacacctccattgactccacaactactttgccactcagttgaaactgttctcacctagattgtcaatgttctggtagtctccaattcagggacagagtggaggttgtataattcatgatgttttattgatgattcctccatctcagaacattcttctcttggtgtctgtgatacctcaccttctcaattttccctattactgttcaagctctggtgtgatctcttcctcattttcttccacgcacaaatgttggtttcccccaggattcctcttgaaacattccacacaatctccctttgaaaactcagtagtccttgtcttcagatatttttcctaagccatgaacatttttctcactgcatattgggcactcctgctacaagtgtttttactccaactccttaaaactgaatttattttatctgccacatcctaccaatgtgctcttttttctgagttttttatctttgggaaaagtaacactattcattctttttcccaaacaaaaacccagcattaatctttgattactcctccttcatccttcacatccaaacttttttgctgttcttgttttaagacagggtcttcctgtgtcacccaggctggatggagtgcagtggcgcattcacagctcactgcagcctcgacctcttgggctcaaatgatcctcttgcctcccgagtagctggggccacaggtgcatgccactacacctggctaatttttgtagagatgaggtttcaccatgttgcccaggctggtcttgaactcctgagctcaagagatctgcacatccagtcttaaaatccaaactgctgttgccctattacacttatcacctggctcctatctactttcttagccttatatcattcttttattctcatttatttctacaacactacattggttttctatttctgttggtttgttttgtgaaataccacatgccttttcctacatgcagacttttgaactttctgttcactctgactggaatttactttccccagttctttacatggctgaatcattgtcttccttgagttctcagatcttataaaaccttctctatatttgttagaataacctagatgttataagcatacacacatatacatacagagagatgatagtttttaatagtgaaaacacaataaaagtttatttcttgttcacttagcattgagtgcatacaaagtttggtccacagagtttcctttttctgcacagtcattcaggaatgcaggcagatgcagattcagattctgtcttatttaacacatgacttccaagggagctctggagttatttccattgctacagcagatgaggaagaagattgagagatcatcatggcagattgttatgggccaggcctgggagtgaaggtattaaagcaataccttgtactaactcaaagttctgtaaatcagaaatttgggtggatttaattgggttcgtaattagggctttacaaggccaaaatcaagagttggggcagtttgggctctcatctgaaggctctgggaaataattcacttctagactcattcaggttgctggctgaattcagtttcttgcagtggtaaggccaaggtccctgtttccatgttgcctgtcagtcatgagctgctatcagcttctaggggccacctcaggtcctttcacatggctccctccatctcaatgatggaggatatccagtccccctcatgcttcaaatctctctgacttttgcctccagctggagaaaacactctgctttaaattgctcgtagttagtttgcacccaccaggattcatttccttttctccatataaggtaagataatcataagtgtgatatctcatgaaattcacagattccacccacactcaaagggggaaaattgtatataggtgtgtgtcactgggagtcattcttagaattcttcctaccacaggttcagaagcagaatcactcaagcatggttcttaccctgtgaccttactaagccttggtttcctggtagaatggtaacaacagtacctactttagggatttagtataaaaattaaatgtgatagtgcatataaaaagattagcataggtcccataactcttctaaaaatggtaaataatcaacaacccatgctattagtcgcagaaataaggaaattattgttatatcatcataaatattcttaatgcaaaacatcctctgcatgcaaaaaaaaagcatgtctctaaacttcatgttcaatttaactcagaaaatatttgttgagcaggtactatgtacctcagaggttagaagttatttataaaactaagatactgtcattcttcctcaaatcattcccagttcaattgcttagacagaaatacataaaactaaatagaatgctgtccaacctgtggtaaattctgtaacatgtgtgacaacaaaagagaagggttcaacccagtgtggaagataaagtgtcacagaagaatgttcacaggctttagagtcgagtttaagaactgaggaacaggcaaacataaggaccatggttgcgtagtcactagacacagaactattaatgcgcatttcacaaaaattaaagagggaagagtttaatatgagtgtgcaccctgggtaagtaatcaatagtgagaagcaaggtgggattgagattatcaaaggtgctaagttatgttgagatatttgaactttgttctgaagcaagagagaaccattgaaggattttcagaaataccacaagacaatcagtgctttagaaaacacatagttggaacatatcattgcttcaacatagcgaagactgagtctgtgtagctgttttctccatttagcaggcataaggacaagtgggttagaacactaaatgcaagaagctaattggacttaacaatacagatggcaaaaggatgaggagaggagagaaacgcattatgtttatttgttaacagctctattgtattgtatttatatgcattagtcagtgtaaaataaaatctgcttattttaaatccttttaaatagtgtttaaatatttcctgatgacacaatctgctaaagtatttacccttggtgcagatttccattaaccttgctgtagatactaagcctacaaccatatatttatagggggctcaattatggggtaaagcctagtgacatcattataaaagcacatctggataagctttagggtctttgtctttctatctgatttaggaaatttagtaaactgtaggagaataccattattaacagcccctgaattctcagattatgaggatgtcctttctctcaaaataaaggaagagagggattaaaatctctaaagctgtaaatgatatagagaaatgcccagtacacagatatcagggatattaggggaatccagttgtgttggatatacaagaagaaaaaaaaggcagaaattaaattcaaagtattctttcctcatgtcttttgtcagtttttttttattgttttttagagagtctatataaatcctttggttccctaaaggacaaaattcctttgataattttacaaattcttttctaaatagtatctctgtattgtagattaaaaaaattaatacctaggaaaggtcaggtcacttctttcagtcaaggaatgactcattcatgaaactggaaagaaaacttctttttcactcaccccaatacttgatagctatcttaaattgaatatgtctttaacagtatatttgatattatcagtgtattttgatttatatatatatatcgtatatattatatatctgtgatatatatctatatatcatttatatatctgtgatatatatctatatatcatttatatatctgtgatatatatctatatatcatttatatatctgtgatatatatctatatatcatttatatatctgtgatatatatctatatatcatatatattatatgtctgtgatatatatctatatatcatatatattatatgtctgtgatatatatctatatatcatatatatatctgtgatgtatatctatatatcatatatattatatatctgtgatgtatatctatatatcatatatattatatatctgtgatatatatctatatatcttatatattatatatctgtgatacatatctatatatcatatatattatatatctgtgatgtatatctatatatcatatataatatatgtgtgatgtagatctatatatcatatatattatatatctgttatgtatatctatatatcatatatattatatatctgttatgtatatcatatataccatatattatatatctgtgatgtatatcatatatatcatatattatatatctgtgatatatcatatataccatatattatatatctgtgatatatatcatatatatcatatattatatatctatgatatatctatatctctctctatctatctatcacattttctttaaccattctatcagtgatgggcatttaggttgattccatgtctttgctatcatgaatagtgctgtgatgaacatttcttttgatttttattgtctgtgttaggacatcataacagggccctcctaataccattaacaacgcatcatgaccctggtaatggttttgtagctgaagtctagatagtttaagtgccctatcttattcatttgtacatattcaatatatataataactactattttctggacgttaagagaattgctgaaaatacagtggtaaactgcaatgaccctatatatcctggtttgtacactgttttatcttctgtttcagttaccttgcttaaatcttgtggctatatgacactaataaaagttaccaaatttgtaataaatagcatcacaaatatttcattgtgcttgagattgtttcaaaggttttgatttttctggctatacacacacatatgtaacataacataattaaaaatgtaatgaacatcactagactactagttaaacaagttatggctaataactaatatgtacacaaaatatgtggacacaatagaacaagcaaatctttatcaataggagaatatcttcaaagtgtatattgtaaagcacttgtgcagaaaagtatattctatattctgctaatgtttatttgtttggttatatgtatgtagactacatctggaggcatacatataaattcaataattgctaaattcctaggagaaaactgggtaatagtgacacaaaggtggagagagtcttaatttttatgtaaggtcttctgtacattttggctatcgtaccatgaatatatattaatgcattattcattcaaaattaagtacaatttaaaaataaaattactacaaaatggtaaattttaaatgttaaagaaaacttggaaaaatataaagaaaaattcaaattgtccacaattttatctaccagacacaatcactaattatattttggcttatgcatttaaagtctgtttttttattattaaagcacagatacaaacatataattgggaccagactgttttacaactttttaccactttataatatactaagcttattaccaaattgcttgctcagcattcttttatgtaacattttgtgtatgtgcattttaagttttttaaaattaataccacaaatgtgtttatgcattatttaaaatgatatattcttcttcctattttgtaaatgttttaatatatatgaaggatgctaaccatttgcatgcactctatatgacagttatttttttccgctttgtcttttgtatttttttactttgtttatggtggtttttaaattaagacatttttaaaacttgtagtcaattcaaatttagatatattttccagcatagtgtcttccttaaatagaaacacttagattttcttcacttcaagaatagataaatatttcctgagattttctttgataatttatactttcaaaaatattttcacatattccagcttctgtgaatatttttatttatttatttatttatttattcatttatttattgagacagggtctcactctgtcgcccaggctggtgtgtagtagaatgattttggctcactgcaaccccgcctcctgggttcaagccattctcctgccttagtctcctgagtagctgcgattacaggcatgcaccaccacacccagctaatttttgtacttttagtagagacagggtttcaccgtgttagcccggctggtctcgaactcctgacctcaagtattccgcccaccttggcttcccaaagtgctgagattacaggcatgagccactgcacccggccacttctgtgaatctttaaattacccaatgatgtgtataagggttcaaattttattcccattttctcagtgaagaaatagagattctgaaaactgatttgatatgcctgaaatcataaagttagttaatgtcatcgctaggactagaattttggtgcttacacaatgtgctgactcccaaatcgtaaatttctaccagatgtttaaagtaaaagaatgatgggaaatttcattaaactattaactatattcagtggtttcaaaatattaatacaacattgatatctttagtgcattatcaatgtattcttggagacaacatgtcaattaaattgtctcttattcaaatgttaacttcagtttttaaaatttaaagctagtctgctgattttcaataagagctgtctaatattgtgaactagtgaatttgaggagataaaagtggaaattataggtctgcagagtgtagcattgataaagagggggccatttcttccaagtcagtaaagaaaagtgatgaaacataaactggaatttttgtgattctactgttgcatgaccttataacacccctgttttaattaactacggacctgaaataataacgtatatttctaatccactcacaggaatggtaggtatattagttagctagggctgccatgacaaaatacaggctgagtggcttaaacaacaggaatgtattgtcttacagttctgggtgctagaagtccaaggcaaaggtttccataggttaggtttcctctgaggcctctctccttggcttacaaattgccgccttcttgcaatgttcttacgtggtcttttctttgtacacgcacaccctggtgtctttattcccatccaaattttctcttcttataagggcatctgtccgattgaattaaggctcatcataatggccttattttgacttaattacctctttaaagaccacatccccaaatatggttacattctgaagattagaatgtcaatttatgaattttggacggacaaaattcagcctatagcagagggtctgctttgcaatgattatgcactattactcaccaaggtagtaaaaattaagcaaacatttatatacacaagtttttgaggggataaagcctacagaatataagaacaaaatattttcaagaatgcctgtctgtggttctttcattaattcacttcttcattcatctttattgagtacgataatgaggcagggaaaatataaccatctgactatgaattgacctggtgcttgtagacatatgtggtttaacagttttccactttgtgtacccctctctcataacatgtagcatactctgctagaattattgattgattaacctcattgtctttctcactagatcatgagtactttgagggcaggaactttatctttcatctttcatcctgaagacatggatcagcatatgtgtatagtaggagaacaataaatagttttcagaatgaaggggagaattaattttttcatgaaaactagatgtcattatgtggagaatttatcagaatgccagactggtaaggatgttcagagacacagtagttgacctaagactaacctaaatctgtttgtatcacagaagtgtaccaatgcttgacatacattggataaaatgtttatttcctatttctctgtattgtttggccacatgactattgcaaagctcataagcacaaaatttgcacaaaacccctgagagatgccatccatggctacaaatacatgttttgattatattaaagtaaaaaaattgatcaattattttaaatattcaaggtagttaagtgaataaattctatgtaattacaaccacaaggttggtgcatattttagaaataaatgcttgttttactatgagaggaaaactgcgaatggcacacgacctaaacaagggcatcctgtttgcttggatgaaaattccatccccatgtttactataccttccactctcattcaaacctagaacaggagaaaaatagttcgagtttaaaaacaaatccagtagagtttaggaaagtttgtctcgtataccacacctttaaaaggctattttgcaatgacaatattcttgtattgccctctctatttttccctccctattgtatacatgagcccagcaacttctagaatatactagcacatatgaaatttttgaatatctatttcatgtagggagattagaaagtcactttctgccacttgtgtagctctattatgcaaaaatcaagaggatgcagatcataaatcccattagggtggaactctggatgtggaaaagactatatagataattttaagagatttcccctcagctgaatcattgctataaagttaagcatggtttttaaaatataaatcaaataaatggtttctataaaggcacatacctttactgtaaactgaactccaacaaacttttgagtggacatttctcaaatacagcatctattgaaaacttcctctgaaaaaacatttcataaaaattgaagcttgccttacatattttcatactatgtggttttaatgaccgttgtattccactctatcaccataaataaatatgtgactttaaaagatatgttgtaaataaaattagctcgaaaatactaacactaaccaaacattaatcacagaatttaaggagactatcagagactaattcagaaaataaaaatattgtaaaattactaccatgaaagctctaagaaaagttcatgataatttcagtgatgctaaggctacagaccaaatataaacttagaaacaaaagtatttagtctaagacaaattaaatgtgtatatattaatttattttctctgtttgatgggcatagaagcccatcaatactctgaatttatattttattaatactctcacaatttactttcatatgtgacttactatgtaatataaaaaacaaaagagcttgaaaaactgagatcagagggcaacaataaaatattaatgctaatattatcttgaatttttatctatacatatttaaatgttgttatcctcactgaaatttgttactaatcagtgaaactttagtatttacctaaattagttcttcttataagtagctcaatctccataataggagatagactataatttgtactttagcataaatattcttctaaaatcattcaccgttttatattgtaattgactgaaacaatataaagtggcttaaaatcattggtatattataaaacctatgtcagataaaacatggcatctgtgaagtttgggaattataacccagaacagtgtataattcaaaacagatacctgaaattatcttgtacacatctcgctatctgctatatctcatcacataaaatgcatagtagatgcacaaagtagctgtccaacaaatacttatggaattaataaatgaaggaatgacaaaaatgcttttcctcaatgtgctaagtcaaatacatgtttccttttataaaaatttaactatatgttttagatttagttgaaaaaatctatactggaatttacataattacataatacatattttaaagtattattcccagtatttatgaacattcattaatgagaatggcttctacattaaaagatcagttagcctctgctatttttgataatgatttaaacttgttaattcttacctgtataatgcattctcctttacaaaatgctggtatggccacttgttttatgttatcctcacaacaattgtaggtatagatgtgataaataatatactcttcctattctgtttttctttttaacaaatgagaaaactgaggcctaaagctccagtgattcactcatgtttacacaaataactctaaactggcgctcagctcttgctaattctttgtctcctcttttgttttgtttttgtttcattttgtttccctaaaccataatgccatccaatattatttaaagtttgcctgcctgcttttgcaatggttcttagctttccacaatagcaagtgcatcaaagaagaaaaaggaaatgattatatggttattaatcaaactcagatatggctagtaccacctttataagtgaaacttatataacaatctcagtttatgtcagtctcttatcccagtgtttaaagttttaaggactgagctgggaatgtgaggaggcttttgcttttcattttgtactctactagttttaatttttcactatgtgcatacatctgcaccccaacctttaaagaattagtttcctgaaaaaaaaggaaaatgcaattcatcgtacaaataaaagcataatcccttttattaatttttagctaacaaacacataataccatcctattccaggtactgtttttaaatgacttgtatctaaatgtaatgttaacgcatactttcgatgtgcataaatatagccaagcagtcctaaattcagataaattatcttccatctactgtatataattatatagtatttcctaatttttataaaatatggtttgtgtgtatgtatactgttactcaaatgaggttttgttgtttttctctcctcaaggtcaaaaacaatatctcactctatcttttgtgtcttttgttttttgatttttttttttttttttttttttgtctgctttgaacagtttttaagaggaaaagaagaaaaggtgtttgggggttacataaaaaaagggagaaagagacccaaatctcctgtctcttttatcacctacaaactgtattgattttcactttcctttcctaaatccatgctttaaagacattgtccatctaagaaacatagagtcccaaagcacaagttttgatgtagtgagcacccattgattgtaccttgaagtggatgtaggtaaacagatgacagatagatcaggtagatatatagatatagatatagatagatttatcttgaattttcctagatcccattaatctgaatgtacaaataagtctcattagttctaatatttgtatttcactgcctcattgccctcacctgctgtagatgatctctgcctccagcaaactaatcctcatgcatttctggggagtccatatgggttttctcacttgcacttaggatcaagctggacaccaattggctaagtgccacggttactccactgggcatctccatgtcccttctctggataaacaccatcatctatgggcataaggagcactgctattcttccattgctgctccaccaggtacctgagctctcccactgctgtgccaggtggaatagttttccaccaggggccaccttagatattcctcgtcaggtgagtaccaggactgctttgctaggtagagctgtcccagtcgattctaatatgcccctctgctgttatatctgtatcactgttctgtattctgctagtaccaaagctgaatgagactatgttaaaagtagtggtggaaaaatgtctttcttccttgcctccctctttcttaagtgagtcctaaaagaatactgagtagattttggtatcttaaaggtttaacaaaacagatcttctttgttttactctaaatacaaatctgagtaaactagccaaggctctcagaatgatctctctcttctgagaaccagggcaccatacctggctccgatttctctcatggtgaattcttcaaaatgttttccagtgcatgggctttcgctgggttatctcccacgttgttcacaatgttcagagatatctgagttaacagcacacccagaggtgttccctctttccatgactgtcccccacaaccccacgccaagaatgccactccccagttctaatggcagtatgctgctggtagcctggccacctgtctcagtccatttagtgttcctataaaggaatcacccaagactgggtaatttataaagaaaagaggtttaattggctcacggttctggaggctgtacaggaagcatggcagcatctgattctgaggaggcctcagggagcttttactcatggtggaaggtgaaggggagcagatatatcatgatgagagaagaagcaagagagagagagagaggaggaagtgtcaggctctttttcaacagccagttcttgtgggagctaagagtgagaactcattcactcccatgagaatgatgccaagccactcatgagggatctgaccccaagatccaaacacctcctaaaaggctcagcctcaatgttggggatcaaattgcaacatgagatttggcagggccaaacaaaccctatccaaaccatagcaccacccaatttgccagatatacccaggcagatctaaatatatcttacactcacaatcaggtcctccttttatgagataccaaagatgttccattagggttctcagacaaacagaatggagaaagagagatttattgtaaggaattggctcacatgactgtgggagctgacaaatctaaaatctgaagtctgcagggcatgttagcaggctagatatccagggaagagttagtgttgtagtcttgggaccaaaatcttcagggcacgtattagtctgttctcacgctgctaatagagacatactcaagactgggtaatttataaaaaaggaggtttaattgactcactgttccacatggctgtggaggcctcataatcatggcagaagagcaagagatgtcttacatggcagcagacaatagagaatgagaaccaagcgaaaggggaaacctcttataaaatggtcagatcttatgagacttattcactaccacgagaacagtatgggggaaactgcctccatgattcaatcatctcccaccgggtccctcccacaacacgtgggaattatgggagctacaattcaagatgagatctgggcagggacacagccaaaccacatcagggcagatgagaggtttttgttcctcatgacacaaaatgtggtgtcttttccaacaccacttcttcaattctctgacactcactaggcatgctatagttcagctcagttctgacagtaactacctggagttagagtaagactccatagatttaagagcccagtcccacaagactaccttcccttcagaggccaggcacaagtattgagtccccactttagccacaattctctccagctgagctacacagtcttgggttcccacaaccccctcttcagggttgataatttgctagaatgactcacagaactcaagaaaatgctctacttactattgcagtttattttaaaggatgcatataaacagccagatgacaaacctcctcaaattctgtttaggggcttttaggaggtttcatgacataggcatgattgatcaaatcattagccattgatgattgactcaatttccagccactccccttctcccaagcggttgctgattgagtagtgaagctgaaagttccaagcttctaatcaaggtttggtctttctggggaacagcccttattttgaagtagtctaggggccgtctgacagtcacttaattagaacaaaagatgctactatcatctttatcactcagaaaattccaaggattttaagagttctgtgccagaaacctggtacaaagaccaaatatcttcttatatcactgcaggccagcagactggaaactcccatagaatttttatcatgcagtcttgaggcagaattctttcatctttgggaaatttcaatctttgctctaaaggctttcaactgatcggatgtggccaacccatactatgtagggtaatttacttaaagtcaactatctataaataaatgttaatcacatctaaataataactttatagcaacatttagattggtgtttgatcaaacaagtggataccatagcctggccaagttgtcacacaaaagtaaccatcacagatgtattattttatttaaaatcatcagtattatatgaattaattcagaaataaaaaaggtgttgtcatagtgtgaacacttataagtgtctttcccacagaaatgtcaacagactgtgatttgaaaattgctgttttaaaagagaaaagctcatcattctacagaaatgattcaaagatagacaatccattaaatatcttataatgggccaaatactactagttgttaatttacacttgcaacatcaaacactttaccagctttttaacatgcaactgttgcatatgatgcattgtgttttttgcaagtaggtatacagcataattctaataggatatttatttacaacctaaccttacaatttaaagtctgctactccattgtgctcatcctacccgctgtcttcttatattcaaagctattaaggagtacttgctcagcatatcactccaaattaaactgcaagacattttatgatgaattaaatgggtgacgctctcccagcctttgtaactactagagcaagtatccaagaagcagacaattttatcacaaaattctgattgccaagttgtttttattaaatagacatacagtagagaatttaatcttagaaagcatctaacataaacacagatttctcgttttatagatgaataaactaagatccaatgagggcaactatttttttccaagttcatgcaggcagctaacaccagaacaaagactaaacaaagctcttctaacttctccccccatttttatcatccattgcattcattactacaaaattactacaaaattattagcctggtctttaatggtggccccaaagaatggtttttagtattacttccttcacttctttcgtatgtcctgtgctccagctaaactgaactatgttgaactaagctaaacatttctccttaagcttgtactgcattttgctacagtctttttgccaactcttcccatccagaatgtcttcactctctatctccactgctttaaaacctaagcaattttcaatttaagttctatctcctttttgaagtattgtatattcttctagccagataaaattctaggaaaatattgtcatacttgactgcataaagatttaaattgtctatatagcaaaataaaaccattattgaaatgataaaacaagtgacaaactagaacaaaatactttatagcatacttatttaataaatatctattgatagcttgctaagtaataggcactatactaggtgctatatccaagtaatgttgacttattagctttcaattagaaaaagagaaacactattagatatgggtcaattagataaacaggcacatccaaaaagaaaaaaatatgtaaatatagtcacagagataataataataataataaatgagatgctacttaacatttttcaaatgtgtaaatattttttaaaattagatttttccatattgattagaagatggagaaaagagctctttcacataatgctgctgtgaatgaaaattggcaatttatatcataatgtgccacagttttgttctgtatggtctcaatcccccctgtaaatgtgtgctctacttttctctaccttgtcctgagctttagcctctggattctctttgggttctgccaacgtaagacacaataaagagaacaacagacaggagggaatgaggccgaagtgtttattcctcaggctctgtgcttgcaagggtccccaggctctgtgcttgcaagggttcagatgggcagtagctgttcctccattgaggggaggcccttcctacagtacagctgtctttccagctggatgtggtcctcagcctaaggcagcaatggcttggtctgtgtttagccactagctgcgttcttattcttgaatgtgccccttaagcctggcccaaatcctgtaaatagtccctgacatatttctcttcaataattccatttcagtgtgccatcttctcccttgtcaggaggaccccaaatgatccctctttgactgggaaattctacttctaagagtttatgcttaaggtgtaattaagaatgtacccaataatacagtaatccatattaaatgttataatagtagtaaaaatgacactagtgaagcacaaaagagaaattaatccaaactgaaagagtttgagaaggtttcttatagggtgtggcatttgatttgtgtcttaagggtagcatgagactatgccaaaaaagaaatgtgtatgtcttgccacccaaaagagatatcttggccattgaggatagagattcattactttcttatgctatataaggcgtagtatagggctaggttgaaatagtattaaaataatatttaaggattgattataggttttcattgagaaccattctcaggtgatactttactaagctgacaatagacttagcactgcctggcaaacagcaagtagcagtcagtgatatagccatgattattactgaattaacagcatcttaatcttcactacgatatttgaaagggaacactgattcataaacctactcttttcctgccacaggtagtcaggaacttattattcttattatgtctcattattaacttctgttgcctaacaagatattatatattgtatgtcacatgaatattttcttacaaagtattaattgattcctaatcttgttaaagaatatgatagtagcaaatatccaactaattctgagagaaaaacctccagttttgcaagaaagatttagccaagttatgcaactaagtttgttcaaataataactctataaagttatctcgattatctcctctttagtttatgaatcgaaagcattgatgaagatcaaaagctaactgatgcctccctaattctatatctatccttgtgcagaggcaaagtaggggagtcagtaggatgtttgtgtgtgtgcgtgtgtgtttttgtatgtgtgtgtagatggagacagagaaccatagcaagatagagagagaacacgagaggagactgagagagaaggaaagagggaggaagggatggatggatgaaacgaggggctttctctcattttatatcataaaagtaaccaagaaaaaaatcctgggttcaatattttataattattacaaatggggtattagagatgttcaggaagccagagtagaaggcagctagctaagaatgctgtcagcctaaggagtttttcatggacgcctttttattctaaccagccacagaagaaaagagggaaatgaagaagcatcatccttcactatcacaactgacaataagggttctcccttacctcccacccccgcccccactacacacacacacacacacaaagtagtgactgaaaaccctcagcaggctgggctcccctaccacatgccacctgctgcaaatgtgttggaggcaccaggtcctcctttcttttttgccagttttcttattgcagaaaggttttactattcaacaattaggagtgtccaaggtgttaggggtcataagatacatccttgttctcaaagcgcttataacactgtaactactgatgactggtataaggatgcttacaagagaaatttattaaaagggcaactcagtagagtacaaactacgcatatgttgaagagagtcaggagatgtttcatggataatgcaaacattgaacagggttttcatgaaagggagggatgtggatttctctgataaggtggaaaacataagcacaaatggaagaatttgttgagtttagtatgtggtttgtgttcagttttaaatataagtccttatcatagcaaagcgatttcttttctttttgtttttgttttttccttttttaaattattttactttaagttctagggtacatgtgcaaaacgtgcaggtttgttacatatgtatacatgtgccatgttggtgtgatgcacttgttaactcgtcatttacattaggtatatctcctaatgctatccctcccctccccgcccaccccccagcaggccctggtgtgtgatgttccccaccctgtgtccatgtgctctcattgttcagttcccacctatgagtgagaacatgcggtgtttggttttctgtccttgcaatagtttgcccagaatgatggtttccagcttcatccatgtccctgcaaaggacatgaactcatccttttttatggctacatagtattccatggtgtatatgtaccaaattttcttaatccagtctttcattgatggacgtttgggttggttccaagtctttgctattgtgaatagtgcggcaataaacatacgtatgcatgtgtctttatagcagcatgatttataatcctttgggtatatgcccagtaatgggatagctaggtcaagtggtatttctagttctagatccagacacatgaaaaaatgctcatcatcactggccatcagagaaatgcaaatcaaaaccacaatgagataccatctcacaccagttagcatggcgatcattaaaaagtcagaaaacagaaggtgctggagaggatgtggagaaataggaatgcttttacactgttggtgggactgtaaactagttcaaccattgtggaagacagtgtggcgattcctcaaagtgatttcaactctacagatcagtttgaaagcacaggactggatctcagtgatggttaattgctcatctggccaaagaaaagcatgttgcaaggttaaggctcctatgaggaaaaggagagcaaggatgttcaggctgaataaagcccctgtttttattaattataaggtcagaatctggttctcctggaatcaaaatgctgagcaagcaattgtggagcaagggctacacaatggcagagatgaatgcaacctgatattccacatgcattctggcgcagctcattgcttttcaggcatctacgagaaacatatcaccccttaggtttgctgccgaagatgtgttctcactgaaccataacctagcagaggttctcaggttggaataccaaatagcaagatgatgtggtcagtgctacctatattgctctaaaatttttaaacatctaattgatgatttgtgggaaggttgcacagagagaagaaaggaaaaccaggaaaaagctgtgtttttaatttatgaaatattaagaagttttcggaagaagacccagacaatatgtattagatcataaagaagcaaaaaagtgctatgtaattttctgatggtagaaacaaataagaagatataaattcctcagtttacaccatgagtttaaagaaaatcatcacctacttactggttcattttgtaaattgagatcaatgaaattctctgaacaacagcatgaaatcaatcgtaaaatagcacataattcatggccagtattgtaaattatagtttgcttgacagtaatcggtaaggtttccatgcactgggatgcatttccttgtaacacgtctaaggataatgcctgtggatccatttctaatgcatattagagtgatctgtttttccctgtccacaactccctgtgtttgatcttatgcaaatgatgcaatcaagcaaatggaaaacaagatgttgttgctcaggggctcttacaaacagtggccttatgttttcagggtttccccaccctccatttacccaactcagatttgtgtacatacctgcaattgtttgaatccgttgatccatttgtgttgcccttgaagtgcctaatcacatctatagagacatattaccaaatcagttgcagttaagctaggaggagagttgtcattactttcctctttgctttaaatttcaaattggtggctttgtttatggcttcactctcaaagaatttatcagcctcacttccctgtaaccaatctttttttcatttctttttgttaactgtttttaaaaactctctcattccattcatacattttacacatgactactccttccccccacgcccaacctgatgcctcctcctcttctccatttttttccctttccctcatcatttcctcctgttttaccaagaatttcccaatcagatcaccgtgcaactttctctgccacatgtcaaattaggttctcttctctctctctctctcttttttcatgctttattattcaaagaacactagtaacatttcatcttcttatggaaatacattgagaataatccactttgggatggacagtacaggcataaaaacaacttggaactcaaaaaagctatttaatcacaatggttttctttgtattatgtttacagttttcagatttttaaaaccaaaagaaaatacccaatttctattgtagtgactttcatgtgagtccgtgtgaagagaccaccaaacaggctttgtgtgagcaataaagctatttatttcacctgggtgcaggtgggctgagtccgaaaagagagtcagcgaagggagataggggtggggctgttttataggatttgggtaggtaaaggaaaattacagtcaaaggggggttgttctctggaggccagagtgggggtcacaaggtactcagtgggggagcttttgagccaggatgagccaggagaaggaatttcacaagacaatgtcatcagttaaggcaggaacaggccattttcacttctttcgtggtggaatgtcagcagttaaggcaggaaccggccatctggatgtgtacgtgcaggtcacaggggatatgatggcttagcttgggctcagaggcctgacattcctgtcttcttatattaataagaaaaataaaatgaaatagtggtaaagtgttgggacagcgaaaattttgggggatggtatggagagataatgggcgatgtttctcagggctgcttcgagcgggattaggggcggcgtgggaacctagagtgggagagattaagctgaagggaggtcttgtggtaaggggtgatattgtggggttgttagaagaaacatttgtcatttagaattattggtgatggcctggatacagttttgtatgaattaaaaactaaatggaataagagaaggagaaaaacaggtataaaaggtctaagtattgggacgactcaggacatctgattagagagtgcctaaggagattcagcatagtcctgccagcaaagattatttatttacttcaagagttaagagtggcagtttggggatagcatgaggagatgtcagctgtgatggcttggagaaacagtgtaaactggcagtgtaaacaagagcaggacatgtatgagtagttgagaacggtgaataggagtatgactagacagaagatagtagggatgacaagtttttttggggcacagtctaagttggtctggtgtctggaatgagactggggcctaataaaaaggagcgtctatacaggagctcaaatgggctgtactttgtagcattccgaggacaggcctgacttctgagaagggaaagtggtaaaagtattgtccagtcctttttaagttggcggctgagcttggtgaggtgtgtttttaaaagacctttagtccgttctacttttcctgaagacggaggaccgtaagggatataaaggtttcactgaatactaagagcctgaaaaactgcttggctgatttggctaataaaggctggtctgttatcagactgtatagaggtgagaaggctaaactgaggaattatgtctgacagaagggaagaaatgactgcggtggccttctcagaccctgtaggaaaggcctgtacttatccagtgaaagtgtctacctagactaagaggtattttagttatctgactaggggcatgttgagtaaagctaatttgccagtcctgggtgggggcaaatccttgagcttgatgtgtagggaagggcctgaataatccctgaggagtagtagaatagcagatggaacactgagaagttatttccttgaggatagatttccatgatgtaaagaaaatgagaggttctaagaggtgggctagtggcttgtactgtagcatagcctgcctttgctggtgtgtgatgattaggcctggtggaactgccatcaataaatcaagcgtgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaatcaagcgtgatcaggctgaggaacaggaaagaaggaaatatggggaaatggggtgaatgtcaggtggatcagagagatacagtcttgggtgtcaggtgtggtatcaggaataatgtgggaggctggattgaagtccgggccaggaacaatggtaattgtgggacttaacaaagagtgagtacagctgaaggagccgtggagcagaaagtatatgcgtcaggtatgaggaagaaaatagattttggaaattatgagaaatgtagagagtaagttgagcatagtttgtgattttgagggcctctaaagtattagggctgcagcagccgctgcacggagacatgatggctaggctaaaacagtaaggtcaagttgtttggacagaaaggctacagggtgtggtcctggctcttgtgtaagaattctgaccgcactaaccatgcctatgaaggaaaggaattgttgttttgtaagggattgaggtttgggagattaatcagacacgatcagcagggagagcacatgtgtttttatgagaattatgctgagataggtaacagatgaggatgaaatttgggcttgattgaagtaatgggggctatctgtgaagctttgaagtacagcccaggtaatttgctgagcctaatgggtgtcagggtcagtccaagtgaaagcaaagagaggctgggatgacgggtgcaaaggaatagtaaagaaagcatatttgagatccagaacagaataatggattgtggagggaggtattgaggataggagagtatacgggtttggcaccatggggtggataggcaaaacaatttggttgataaggcatagatcctgaactaacttgtaaggcttgtctggttttaggacaggtaaaatgggggaattgtaaggagagtttataggctttaaaaggccatgctgtagcaggcgggtgataacaggctttaatcctttcaaagcatgctgtgaggtgggatattggcattgagaggggtaagggtgattaggttttaatgagatgttaaggggcgcatgatccgtcgccaaggagggagtagaggtatcttatacttgtgggttaaggtcgggggatacaagaggaggacgcaaaggaggctttggattgggaagaggggcagcaatgagatgtagctgtagtccaggaatagtcagggaagcagataatttagttaaagtgtctcagcctaataagggaactgggcaggtggggataactaaaaaggagtgcttaaaagagtattgtctatgttggcaccagagttggagagttttaagaggtttagaagcctggccgtcaatacctgcaacagttatggaggcaagggaaacaggcccttgaaaagaaggtgatgtggagtgagtagcctccgtattgattaagaaggggatggacttaccctccactgtgagagttacctaaagctcggcatccgtgatggtctagggggcttccaaggcgatcgggcagtgtcagtcttcagccactaagccgagaaggggtcagtcagagaaccttgggccagagttccaggggctctgggagtggctgccaggtgagctgaacagtccgatttccagtggggtccggcacagatgggacgtggcttaggaggaatcctgggctgcaggaattccctggcctggtggccagatttctggcacttgtagcaagctcctggaggaggaggttctggaggaaggcctggccgctgcagttcaggcatttggaagttcttgtgtgctggagatgtggctggggttcgtctcacagtggaggcaaggaattgcaacttttttctattattgtacaccttgaaggcgaggttaattaaatcctgttgtggggtttgagggccagaatttaatttttggagttttatttaatgtcgggagcagattgggtaataaaatgtatattgagtataagacagccttttgactttttagggtctagggctgtaaagcttctcagggttgatgccgagcgaccatgaactgggctggatttttatatttgatgaaaaacagcctaaacgctatctgatttgggataaagaaaaaggagcattaaccttgactatgcctttagctctagccacctttttaagagtaaattgctggtcaggttggggagggctagtcatggaacgaaactgtaagccggactgggtgtaaggaggggaggtgataaaaggattatagggtggaggagcggaggctgaggaagaattgggacctagcttggcctggcgaggagcagtctggggaggaggggagaggtcagatgggtctgtagaaaaggaaggttagaaagactcagccacgcttggacgcttggggttgagactgaggggacaggtgggagggaaagaaggaagatttgggacgagttgcactgggcacagagactaggaagggaccgatgtgtaaaagaatgcctagacgtcaggcacctcagaccgtttgcctattttatgacaagaattatttagatcttgcaggatgaaaaaattgaaagtgctgttttctggctatttggaactactgttgagtttgtattgtggtcaagcggtattgcagaagaaaataagacacttagattttaggtcaagtgagagttgaagaggttttaagttcttaaaaacacaggctaagggagaagaaggaatggagggtggaaggttgcccatagtgaaggaagcaagcccagagaaaagagagagtagagacacggagggaaggggttcaggggttcttaccctccagaaaagtgggaaagaggttggggcatggaaataagggattggggcacagagatataagaggtcagggtgtggaaataagggattggggtgcagagataagaggtcggggcacagaaataaggtattggggcacagagatacgaggttgggatatttgcccctcccccagaaaagtgggacttgctgctaagggtgaaggagaagaggttgggggtttcttgccccccagaaaggcagagaaggggtgaataatcagagaggcgtccctgcaatgattaaacaccaagggaaggctccttcccagtccgtgactggcgccagagttttgggtccacggatgaaacatgtctcctttgtctttaccagaaaatgaaaggaattgaaattaagagaagggagagattgaagagtggaaaggagaaagtggttgagggatagtgagaaaggttggagaagagagtaagaagaggttgcttacccaatttaaaattggtgagatgtcccttgggctggtgggtctgaggacctgaggtcgtaggtggatctttttcacagagcaaagaacaggaggacaggggattgatctcccaagggaggtcccccgatccgagtcacggcaccaaatttcatgtgcgtccatgtgaagagaccaccaaacaggctttgtgtgagcaacatggctgtttatttcacctgggtgcaagtgggctgagtccgaaaagagagtcagcgaagggagataggggtggggccgttttataggatttgggtaggtaaaggaaaattacagtcaaaggggggttgttctctggaggccagagtgggggtcacaaggtactcagtgggggagcttttgagccaggatgagccaggagaaggaatttcacaagacaatgtcatcagttaaggcaggaacaggccattttcacttctttcatggtggaatgtcagcagttaaggcaggaaccggccatctggatgtgtacgtgcaggtcacaggggatatgatggcttagcttgggctcagaggcctgacagtgacgacatagcagtcagatttcccaaaccagaaatctgacctaacaaactacttttttggtgtgaattagcttatcttaaaaacttagaaaacatttcaattgtacctaggttctgaaaatcttgtctgtgtggttatgataagcataggtgaggtgctggttgagtatgtggcattcataaatttcagtcttcaagacatatatgtatgtctctatctctgtgtacagttatgattttatttctataattcagtttaatatctgactttactcccatgcaacttagtagtaagtaaatcacagtcactttgggggtccccccacctctactaattatgtaaaagcttctggggtcttacctagttccttagcatctggagtgtggccacccaggatgctttctttctctgtgcaaagggataactattgagacaacccttccacattcagtgggtatcctcagtgcttctacatcacacttgggcaactgaaatctttacaaggttttctgtggccctgcctgaatacagacaccaaagtctttctttttgctctggtcttgcccccgacctgggactctaccttgaaaacaggggtcagggcccctccttcagagagcttgcacatttctacttccttttatccttattccatcaggcagggaattctgaattagggaagtggaagactccatacttcctatttctcccaacattatatctgagggaacagagtcttccttctctgttccctcagtcactctgtccagaagatttttttgtttttttttctgcctcctgaccagtcacattctgttttacagagaaatctattttatagttaaattctgattttataatttaattgagtgtactagttcgttttcatgctgctgataaagacatacccgagactgtgtaatttgtaaagaaaaagaggtttaatggacttacagttgcatgtggctggggaggcctcacaatcatggcagaaggcaaaaggcacatcttacatggtagcacacaagacagaaatgagagccaagggaaaggggaaaccccttatggaaccattagatctcatgagacgtattcactaccatgagaacagaagggggaaactgcccccatgattcaattatctcccaccgggtccctcccacaacatgtgggaattatgggaactacaattcaagatgagatttaggtggggacatagccaaaccatatcactgagaagcatttagataaaaattaaatgcagaaaacatatagggtcggtagcagggaaggacggaagaaataaaataggttagtatgacaatcagattgatctcagtacccattgaacaaatcctgagcattgtaggagtttagaagaggaagctctaagggcttcaatgtaaacccttacttggttcctcaagagaattgtccaaactatgaaaggagaagaaggaaaaacaaatcaatataatgaagagagtcacaaaggaacaacataattatggctgaaaagttccaaaagcccagttcaaactggaaaacctgaaattatactagactctttcagtgtgttcagtgacatctctcggaaacatcttagagatatgagaagtattagagacataagatgataagatttatccagaagtgggaactgggatagccatatagaagaggactggggatgtgaagaaccctatgtgacccagggagtatggctttgtaatggatgatcaaatttcattgatgagggaaatgaaactattgaaaatatctgggaataagaaggtaccaagagactggacattgtgtagcggcataggagtgattgcattgatgtgacaagtggaagaggtgggaagtaaccagtttgtggtcagagagtgcaggatttagatttagaatcttggaaatcattctgaagattatgaagtagtaggtgtaactatgctgaatgttgaataaatgaagtagaggtgaagggcattgcatttgaggaagttaaagtaaagccagattcagagatgagtcattattgaggatgttagagttgccaaaaagggattatgattgaaaagaaaactgagccaatgctgaagtcatagaggagagaagcagtgtgaccggagatgtgatgggggcatgcgttaactaggttggggcatatcttcttttaaataatggattgatattaactatggctattttttctccatctatgatataaatatatatcacaaaaaatttgaaaaatatatgtaacaaaaattaaatcctctatatgcactcactcagaaaaacattgttaacatttggtttaccactatctcctgttttgtttttattttttttattgtttctttcttttacaatgaagcactggtactttaaaattatgttttggcattcagacaggtacagctttgcctttttctcgtatttaatggtaaatctcctttgtcttacaactatagacccctacattggcccaacaattatattcattatattcttggagactttaaaacatgtttagacattactatatttctgagaaaaaaaaatggcagcctgggtagagggcatggggatatccttctggtcttgctcattcatttacaacaagtaaaattatgcgagttagtcatcacaccattcctggagatatcctgctgaacatgataaaaaatatttatctgaactcaagaagtttacattctcctgggaaggatataatatcaagatataaatgaaaaggcaatattgaacttgttttagtaattatgatatggaactaaacaaggtgatataacaagaacctggggatgatggtggccatattgttcaattatcaagaaagaccactcatagaaggatgaagctgaagcataagaaagagcaatccaagtacaaagagagagaaaatagatttcagtcagaaggagcagcacctgcaaaggcccagaagtgtgaacttgttgtgttagaagaacagaataatgtctagtctagtgtatgaaaaaaatagggagaatgttacatcaaataggatctcattgaccattattagatttcgttctaagagcagaagaagggtactacagggtgttactctgaagaatcaaaagatcactcatggtaaatggtcttgttttcttcattgggaaaattgaagtagttagaggataatgcccatagactctgctaccatctacccacctaccagtattggcacccacatagtctgcatcccctcccattactatagattgtctctgttccaagttcaactctttcacttttgaactagattctcctctttcacatattcaaggacaaaactccagcaatttttttctctttcatccacttcatagttttcccttcactagtgggtcatcccatcacatacaacaaatttttctctcatttaaattactttaaaaatcttctcttgattctacttaccttttatctattgctacatttatctgttctcctttaccacaaaactttttgaaaatgttcttttattcactgtttctaattcctcttctatttccttataagcccacttaagtcaggctttagtgctgacaagttcactgaaacttcaattgtgcaattactgatgactgccatattgttatacccgatggccgatttttaattctcatcttatttcacctttaactcttaaaaattacttcctttgactttcaagacaccataatctcaatgttttcctcataccttactggtcactctctgtctccttggttgatttctcctttactcattggcctcatatgttggtatcccagggttttctcttttatatctattctcactccgtttgcactcctagccatctatatgatgatgacttaccaaattatatatctcaagccatgaactcttcctgtaattccaaacttctgttcaaatatcctgacaatctcctcttggttatctaactaacatagcaaatgtctaattgacattcattatatgaattcttatcttcccctccatgccttcctcaaccaataaaatggttactttatccttccctttgctcaggtcaaaagccttggagtcaactctgggtcttctctttcatactctacctacaatgcactgggaaatcctgttagctttgcctttaaaacatattcagaatttaaccatttcttacttgattattactggcccccacttacttgatattacaaatagcctcttcagtgagatgtattcttatgctcttgctcactaccatctatacgtctggcagccaggatgatactcatgaagtccatgtttgattgcatgacagctctgttcaaaatccttagtgtcttcctaagtagaacctcttagattaaaaaccaaaattcttacaaagacctacaaggcctgcatgaactgacccctcattaaatctctaatatcatctctaacttacttcttcctaatttgttctgctccagccacctcagcctccctgctagtcctcaagagtgtcaggcatgtccctccttccacagctttgctctgcttgttccctctcttggaatggtccaacccaaaaattcccataacttttacactcatccccacttcaggtctttgctcaaaatgccaccttcccaatgaggcctctgctgactcttaactattaaaattacccagaacttctaattctccttcctctgttctgtgttttctgcagcagttttcatgtaatgcagcatgaacatcttaaactccgttacacattcactttaaagacatgctatcttctaaaatgcaacacctttcttacccataaacttcataataccttggataatctagaggcaaaccctaactagggatggaggatttgacaagctcaactaaactatttctatttcaatcctggctcactagccattctaaccctctcaagcaacatgagaggtatacttgttctaagtatactcacttcccatcctgaccgccccctgccccagtcccagttgttatagaaacggacacttcccactccatggaagaatccgggcacggataacaaatcctgaactaattgcttcaggaagctccttccatctgaggcggatattctgggtgggtttagggcttaggtgatcatagtcaccttcaacgcatgcagtttataggggaaaggtgagtggggcactctgtgataagcagacactgcgatatgtgataatatgatgatgcattcttgagatacctaagtcctaccttgagatacctaagttccagatatgcaagtctgtaccatggaaacatacgcaagcaagcatcgggcctttttgaatggagtaacttcttcaccacctacaagttgggtagctaaatccccaccccagcaaagtagaatgtaagaaagaaggaaaacctatcccactccaaagagttcactggccaaagaattttgtagcatccaatctcggttgcggctgaccaagacaatctgatatggctattatatatttcaaggtcacgtggatttggccacatggaatataatttctggctggagcatgttctttcagaaagttggatgtgttctcagttgaaacactataggttttctccaattgcactgaattacccatcaggaattcctctaagcttggtgacctccttggttttgctcctgcaacgggacttagagtcaaatccccagcttctctttttcagggaggacaaggaattcagacagatgagaacaatgagagagagaaaggtcaccagagagcgaagatgaagagaacagaggaatggcagatacaatatgttagcatataaacacattataattttggccaagattggccctgtcggtaggagtttttctttgcataaagttttctctcagtaaataatagtctactctctcggtagcatctgaggccactgctgtaatgattttttaacttcataagtttcctagaacgttggtccaaatgaaggcaccccagttatgtctcagtcgtgtacctatagtgcgactgttgctgccatctctcagcagtccctggcaatgccacactgcttcaccatcagcttcaaagtgtccttgaagtatatattctgactacattgaatgggagtgccccatctcaacttgcaaccattggattcctgtaggatagaatttgtaaagaaaacaaggtttaatcaaaagcattaagagtctcttcttgttgacaactttttgttctaaggtaaccatatttactgtaaattatttttttaatctctcttctagtgacctacatgtttaaccaattgattgtactttgcatgaaaatcaaagtgttctttccccagtttacttttgttatcagtgcaatgcaaaatctgtttgcctgaattaggttgcatttcattaatctcttcaatatgaaattgtggtggctcatggttaatgagatttaagaatctgtgttacttaaattgtgactaacttattttaaaagtatgtcagaaaataatgattgtttctagtagtgttaaagtattaatgattagtaagtcttggtacacctgactgaactttggttagattaccaagtgtaatgaagtgttcaggatatttcagaattgagttagtatattacagattagtttaatctaatacaagagaatgtggtatctattagaaagacagacaatataaaataccagggaagttcaggggagggagagattctttcagcctagggcactaccctagtctcatggtcatctttcagacctagctcgtttcattcattaattattcattcattcaaacacacatattcaaaacctacaatgtgccaggtattgtgctacatactaaggatgcaaaatgaatatattaccattcctgctcttaaggtatttagtgtatcatatagtcatgacacagtgtttttaagtgttaagctaaaagtatgtacaaagagaaagagaagaggctaatagctccatcttgtgctggggtgacagcaaggagtgttagggacatcacaaggaagaaacaggcatctgcactgcacctcgacaatttgaaggtcaaataatagtcaggtggtggacaggagaagaatggaatctgacaaacggaattacaagctcaaagtcattgttacaagctatgtattggcatttcaaaggcaactcctgttgtcttcaaatatgctttaaaataatttaaacatctcatttatttttaaacagagccattgaactaagactaaacttagcaaatgatttacctggtcacagacgttcaagaaaacagtaaaactgttaaaatgaaaaagtcaaaacaagagtttgattgacacttgtctatttaaacataaccaaagtatatttaagggatgaagcatcctatatgttattgctattgatttttatggctatttattcatattttaagccttatcttaacaattctctgagataggactatagtggaggagtgaaatctcctcaataagaagtataatgctgagtaaattcttgtttctccctatcccctagatttagcagtatttacaccccaccagtttctactaagtgcatgcacacatgtgggctgtacaaacagttcctgggtcctactgtacacagcacagctgccaccagaacacgtggattccccagttctgactgtcctggattctagaactatacacatacagtaagtagaaatgttgtctctctcacatgctggttcatgcaagaatctcagtgagttcaatcaggggaggagcttgtgacataaaattaattttattgtgattaaatgcatagaagtgattagttcagtggatctgggaacctttgattatcacttgccagcctaatttccattttgtctttatgcaatcaggctgagctacataggtacacagattccatgcaaacttcaataaacaaaaaactgaccactttcatgactgccttgaatattttatgtttggggcattatttgtaataatttggaattagaaagtatgtatatctttttgagtatagtccaggaccttcttattcccttattacctgcagttgatgtcagaaaggaagtttcacatataggcatgttctgatgatttctggtattactgattcttgtccatttcctgatacctgaggtataaggtgtactattgtgctgagctaaaatctaataggtctctcttatcaagagttaatacttgttcatatttatctcttctggactcagttttcttatctgtaaaataagagtttagactaaatgaattctgacatttattcaagccgaaaaatattatgattcagatctcattgttccatgtctaaattctcctgttggcttcattgtgcccctaagccaagccacgttacttagccaaaaagatttcccacgactcaggtgtttctcagcttaacaatttcctgtctgttctatgacttgcccttctcatttccactgctaagttgtaaccctcatctgaaatgccctctgttcttccttctacctatccaaatccaatccatctgttaagaataaaatcttatgtatctaagtagtgtgtcacttcattcaagaagtcctgcctgattttttcagcccttccagtcatcaatttcactgttttctctaattacatattaaccctgtgttggattcctggattttccaggacaattatattattccctcttttccccatatctaagttctcagaagttctgcttctgaagtttttgttctacagcttaaattcaaaataaatactcgcttatacatttttgtattgttagctaattaaaattacaggtaaccagatggcaggagccatatcacatttcctttttgcccctcagaataggcattggataactacttcagtgttttattttaaatgaatcaattttgagatttatgttttttaaaaaagtgtcacaaatccaagttcaaatgtgtcctttgaaaatcctgtatattttagttttgacttgaatgaatgataataatgtattttaccattcccaggtggaaacaaccaagaaaaataagtgggattctggaacgctatgtattatatatgtcaaaccatacacatgattttacaatttggagtgtcatctataacagtacagaacttttccaggatcatatgctacaatacgttttacctggtaataaatatctcatcaagctgggagtaagtttatttccatcactttctctgtccccattccttccacttcttctccccttcccgtggtccatcttttctttctctctcacttaaaaaaaaaaaagtcaaaatcttcatgtattgctgtttatactgaaaactctcttcccatcctaaatgtgaattctggtgatctaatacctacacatttattttatattatgcaaatgatagaataacaccctgagtcagtagattttcccaagtcaaagttgggattatcaagattttcaaaattacttgtagaacatcataattgttaagaactttttctaaagtgctaggattcataaggttatttccctgtggcatttgtattcatttaaaaaacaatgcacagtatgaaaatttagatcttatatttttaaatggaagtttaaatgaccgtcaaatattcttgattgttattacattctggtttatattatgctcctatctcagaagaacagtcacttaataaaaccccagaatcaacatagtttagaggttcccttagacaaacaatagcattttttaaatgcaaaaatagcacttttacacaaaggtcttttaaaagaccttgatattactgtggaatttatactcagtaattccttttgttttttgatgaaatataatcttttttaagtttaatagcacgtctgaaaataactgaatataaacatgagattgtccctatttgttttaaacacactcttcattttatagcaatacctatataaggatatttgctttgataaatgccatagaaaatattctgctcttgattatgaataaatttacatttatgtagacactgtgtatgcattcattttacttaacatgctcttgaatgctctaaatattataccatgagaaaataaactacactcaactattgctaactgtctgacttaacaccacaaaacaagggcaatcagacagtggttaaaaaaatactgttcaaaactgactccatgtgcctaggtgttctgcacagcagtttatgaaacagcactttggttatgtacagttttattacccattaagtaagaaatatactaacttgattttcaaatgctaacacagaaatacaaactattttcaaaataatggtagtatcaaaattaggaagagtcttaattttttggaagcaaccaaaactaaaccaaaaattgtgctcttggttgtttatcagaagtaggcaaatgacatagaacagattctcttcctagggccgtttttaggatgtgctgtgcagtcaatcaattcatatcaatctcctagattttataaatctataataccttgaaaaatacatactagtagattaggagtcctctgccctgagtattaattcagattttactacaaactgtgtgacctaaggcaaattcacttaacctcactgagttttattttcttcaagtctaaaattagaacattgaactaaatgatgtttaatgtctctgagccataaaattctatgatgctaaaaaaagtaatcccaaacactattctatggagtcaaatgctatctgtcagccgctgaatagtgttgatgcaagatgttataaagatgtgaaaatccttgccttaactcttggtagggaaataaacttgctcacattattttcaagttcactatatttattagggcagaaaataatatattttcagggaggattcaactaacagggtttttacttaactctgttaagcagtaaattaaatgaaccagaacattttaggttcatcctggttaattgagggattattgtatatttcacagtttcaatataataactggctttcaaggtcattagattagtagatcgagagcaggttctcagcaaagtggagttgcctttatagatcattttagcatgtcgactaagagctggaaaacaaaacataaagataacaaagcctttaagcagcatttggaatagaggaagctacacggggatttgaaccactatgatttaccctaggcttggagcaggtatgttacttcatgtaacgtcatttagttttcacatttgactggattataaactgctgaaacataaggactgaatctttcaaaatttgatctgcagtttcaagcacagggcctattggaaatgggaagctgagcaaacaattcctgaatgaatgatcaccaaggacatcatttcataaaggttctaagacttttgatatgaattaaataatttgcttggaaacactggaattaggaatggtgtggttccaaaacatactctttccactgcaaaaaaaaaaaaaaaaaaaaaaaaaaaaaaaaaaacataatatgttgctactctcaacaaaggctattttgaaatgtgataaaatgtgatagctcctaataaagaagacaatatgttaaaaataaaataaagaagctattaatacagacagctatcaagacaggtgttgcttgataattttcataccactgctagccatttgtaacttgatgaattctaagtattatatattcctgaaagattcctggaagtggcttcactttttaagtaattatggatcaagtggcctttttctttttcttcgtgctttaaaatatgttgcactcttaacatccccaatccctgtggacctgaaaacttactggaaaagagaatgctagttttggtccgggcacactggcttacatctgtagtctcagcactttgggaggcccaggtgggcagaccagttgaggccaggagttcaagaccagcctggccaacatggcgaaaacccatctctacttaaaatacaaagaatagccgggtgtggtgctgcaagcatataatcccagctactcgggaggctgaggtacgataatcccttgaacccgagaggcagaggttgcagtgatctgagatctgccactgcactccagcctgggcaatacagcaagactccatctcaacaacaacaaaaaaagagaatgctagttttggattgtcttaatagtcatgatttcaaaaataattgataaaattttattatttatgcattttattgtaccaaaattgaatcccttatttggccagatgttactcatcatttcaaggcagagttatgcctttatgaatttttcaaaatggctgtaactgagaaaagctataggcgatggttaaaacaacttattttaatggctctcaggctttcaaagaccttgctatttcataaaggcatttttaatcaaccccactattttgtttagtttttccagaccagaattttaatcagcattcagctgtattgaatgtagtggcctctggtgcgggcaggtcaaacaagatactgattggttcaatttcatttagatgatgtcagattagaccaattggaagcagctttaagaacatttattttcccatcaaaggaactaagataatgtcctgcttacttaggaccctctaaatgcatccaaaaagaatgtgggcaaaacaaaataaaataatttgcaggtaattctgttatttcagcagcctctttataaataatttcatttacaagaaaaatgctttcataaatgccttacattcttaagagatttctttgtcaagttactggtttatggatctcagatgacatagtagatgaaacagtccttctaaaccaaaggatgcttttacttatcctagaagacatcataaaatcctcaaagtaaattttaattcacactgtgttttaaaaatatatacttatatgttgtatagtatagaatttatttggggagagttagcaggggaaatattttagtatacaaataagaaaaaaatagtgacaagtagactatcagaattaaatcccagtgtgttacaagtttaacaataagaagctgcaacatttttcccttctaaggaaaaaaaatctgaaaaatgcaaatggatggattttttttctccctgagaagtgggaaaaatttgtctttgaccatttttcctttgataactcagctgtctcatatggcctcttttcctgccatattttctggtggacttttagcacatttgaaatgtctggggtcttcaactttttttctattttaatcgttgggcaattattttttgagctcacagtgacctgtcctaaagctttgagtcagagtttggccacatttgcaaagattccattctctagaggagtatggtttttttcttgcacagaaaggcacatgccacagctgagaattagaggaaacccacagaggttaattaggtacccaatcttaatgcaattttcatgctcaggccacaatttaacccatctgaaagttgcttaattaagctggtaagaaattatcctgaagacatgggctattgctatagtcttgtaatagcaagtgagattaatttccatgtttgttgaccataaactgttgtttatgcttataatgaagaatttgcaactagttgcaacaactttgcaaatagtagtgtactcccatatttaaaaaaaaaatctaaaaatcagtcagcttccttctgtctttggggaaaagaatatcgactactttaagaatcacaaaatcactcactcagtatcaaactgaaaaatcagagagacgcctaaagaaagagatgctttaattttttatcttagtaatatctgtcttacacaaaaatgagctaaatatctctgcttttttacattgtcttatgattttgctttattttctttttgattttggtaaaatttagtgccttttgaaagatttttaaactttgttgtatcaattgaaattgtaacttgaagagatactgaaccaagcttaagtatagttttcaaatatcattgttatataaggatataattactaatatttgctagcaaatatgggctgaaaaccccttaatgtatttatcaatttcctggagaagtgcttgtccagtaagtttaaaacattatttgcagtttattatgaaattgcacacggaagtttctgtaacattcatgttaccatttctgacattagtgatacttaattagggaacagagagttctgtgatcatgttaaatttgtcaaacatgttttaatgaagcctatctactctgacacataagtaaattatgtgatcctttaagccattaaacattcactcaaaaattgctttgtatttgttgttttatgagaaacattgttttatttaattttatttggtgttatgctataaacatattggtcacactgtagaaataaaaggcaattgtatttgctgcacatcttttcttccctagaagtcagttgttttgtcttaaagtagtcttcatcctctagtactttacttatgttatgtgtacacatgctgtgtgtgtgtgtgtgtgtgtgtgtgtgtgtttaattcactctgggaacctttgtgcaaggctaacttcagcagggctgtttatccagtcaatatatgccctacatctctaggctctgacttaagatgcttccttaattcatacattcataccatctcagttattctctaactattggggatggctatcttatgtcttaaaaagcaaattaaataaatgttaaatcttaacactgaaatgaatttattttggggaagtaaaggtagcactatataacaaaatctgaaactcttattatgaattctctttcctcaatgttcatgaaaacttttgggaccaagagtgaaatgagcatttttgcatctctgtttaggcttgcacaggtggtgggtgcacagtgagtgaggccagtgaggccctaactgacgaggacatacccgaaggcgtgccagcccccaaagcccactcatattcacctgactcctttaatgtctcctggactgagcctgaatatccgaatggtaagtgaactcttttagcctcaagttaaaaagatgattagcaaaggtaaattaatattctaaatggcagcttatatgtggtgcttaatttttaatgatcattttagcacataaaatacctaagatagtatcattgtctctagttggggagattgtggtttttaggctaacacacaattttggtggctcaaaagtgctcccttttgatagtttttgtgtactgcatctcattgtttaatatgctccaggagaggtgaagagagcaaacggggaggattcccaaagaatgccgtagtgagagtgacattgtattttcaatgactttctgtttttaaaagccattagttcttccttggcgaaggagagaggtggaaagttcatgtacatattgtgtcaaaacgcttttgatttaataagtttatcttaaaagaggccacttggaactctgtattttttaatatactatttataaatatttcaacatgctgtttttaaacaatgcatagattaaacatacatatatttatacatatttagctggaggcaagttttgtgcatttctaagcaatatatatgtttttgtacagtttagtgaattaagctagtcagttacgtttcactaaaataaaatctcattatgaagaatttgtaatagttttgggtagaaattgctttattcatttagtggaaatatctttaaggttcatataacatagtaccattgtttcacactgatggaagcttacttgacattaaatttcattcctctttgagacaaatatcaagaagacttttaatatagaaactcttttaagaaactcattactgaaaattgaaatgggctcttttagcacagccaaaaagaatgaaagaaaaaagttacagttttattagtttgtcttatgtttactatgatattaattattccagccatctcattttaattaaacttttggcaaatgcactagatatatttgaggtaatggagagaattctaataatcagagtgaattattatctctgctattgaagttattcctgtactattacaaattttccaagaaaaaataaatggatgcctatttgataccatattaagcaatcaacaatcttgttatgcttcttacttcacaaagtaccctagttcatagatgacaatgaaaatgttaatgatttatttcaattggattgctgtgaaatgctgttacatgatttgcatagtagagcacttcccttcatcccaattggttaatacaactagaactacaattgctctcagaatcttcagctgttcagggaaacattttccacattacaaagctctttgaatgttttgtgtatttgcgtatgttttgtatatttgcaagcagttttaaaatgtactcatcaagcaagaagaatttgggagattttggagatttgtattgacacttccatggtattccaaagtcttgtgtttaattagagtgggatttttagaactttaattgtggtacaatggttagacatttaaaaggcagttttattttttttaaaacgactttttttgtttttactacttctccccactttcccccaattttttagctttttgtttctcttgttgattgtctagagagggataatctgattgttggaaaacatcttgtctctccatctgtcttcgaagtccccacacctctcctcaaatacccaaagaataaagtctaaattttttagtctggtattcaggttactaccaacttgtgactcaacctgaatacacattgccttataacatatcttcctttctagccatgctggaatatttatggcttaatgttgggttggaaaacatgggtggagtcaaataggcctagagtcaaaaattgtttctgatgtatagtgactgtgttacctcaggaaattcattaacttccatggaccccaatttccttgattagaaaattgagattaacaggctgggcctggtggctcacgcctgtaatcccagcactttgggaggctgaggggggtggatcatgaggtcaggagatcgagaccatcctggctaacacagcgaaactccgtctctactaaaaatacaaaaaattagccgggcatagtggcaggtgcctgtagtcccagctactcaggagggtgaggcaggagaatggcataaacctgggaggcggagcttgcggtgagccgagatcacaccactgcactccagcctgggtgacagagtgagactccatctcaaaaaaaaaaaaaaaaaaaggaaaattaagattaacaatccctgtcatcaccctgtccttacctgtagaaatacaactcattcttctaggctaaccgtaggcctcttattccatgaaatcattctactcttccttaagtttaaagtaaactttccctcttctcttgactatgtgaactgtttctatgccttcataatggaacttcattcagcctgtgcttaaagttatttgcgtatatgtcaaacactcccaccagatgctaaggaccataaatcattaatttctctttcactccgcagagcctaacacaatgttctactttttattggtacgcaataatatttaattcatttaatgtttcttgtggaaattacctttgatcagtggcatatatactccaaagccctggctctttaatgataccaagagagatgatagaagtacttaccatccagtgtctgcaatatatttgttcaaaatgcatttgttcctaaaatatatttttctagctgtgtagattctgaggctgggtttctcttttgagaataccgatcttgcatttgaccaaagaatttttaattttcttttctggattatgcccaattcaaagttaatggtaccaggctcacatggcaatatatgctacctaatggttgctttctaatttctgaatatgctgctgaagagaaatacaattggagaataagatagacttcattcttgtgtaactaaataaaccctttcaaaagattttaaatggtatttctcaaacttatctgattcttagaacaatcttgggagcaccaattgaataagtagattctaggctccaccacagacctcctaaataatcagaatcttccactgcctcggttatcatcaaaatacccctgggtatttactacattttccaactgagacctctcacaaaatcctccccctggatttttgttacatcttaaacccagcatatccaagttgatttctcctcatggtctccatctctctgcttgctctttctcctgtattccctctctcatggatttgcaccacccagccctgccagccagtatactgggcagcagtcttcaccttaaaccttgctcacccctgactgctgtcaccacacaacccctcgactgcacttctctagtgaaggccattaatattgctcacccagatcgcttcaggagcctcctcatgccatgcaaaaaatttgcatttgttcattcaaaatatgtattttgatgacctactaggttccttcactcttatctatacagtgcatttccttgcttcttgatctcaaggatatcagagtcctcggggaaaatatccatataaatgaattctcacaaggtggggaggtgcacaaggtgccaggtacacagagaagcagctcctagtggttccctatgagatgtggacatgtcatccctctgcatcctcacgaagatgttgcaggaccagatatagacatgtgtttagtctgaaacaggtattacttgcctggttttgcacactcaggtttcaaaatcttgactctgttaatcagttatgtacctaaaggtatgtttgttcactagggatttataaacatgaacaaagacttgttgagaaaaattaaactcaatttctataatgagaactaggtatatttttatgcttgcctatatatgacaaaatatgaaaggtataaaaagttctaatataaatgtccagtccttgccaatcaaacaattggtagcctttggccagcgtggcttaggaaacattctgtccttgtcataactgattctgacttaaatgatcatctcctactcgtgaaagtctgatggtaatccttaaccaatgctttaagaaaagatcctctccccttgttatttcagttctcttccttgtctcccagcctggtcctgctccacagtgtctgtgctggaaagcttgctagttggttcagtacatacttcatgagccctgagaatttttcctaatttggtgtcttttgttcagcagtgtaccagcagctccaagaatagtgcctgagacataataattgctcagttaaaaaattgttgattaccattattaaagaaaaaaacagaaaacaacatgttctggaaaggatgtggagaaactggaacccttaaatactgttggtgggaatattaaatggtgcatctgctatgaaaagtagtgtagaggttcctcaaataattaataatagaattattagatgatgtagcaatcccacttcttgaaatatatccaaaagaattggaaacaagatgcattgcagcattattcacggtagctacgaggtgcaaacaacctaagtgtctatggacagataagtagataagcaaaatgtgatatatttacacaatggcatatcactcggccttaaaaagaaggaagtcctgtcatacaatatgctctggatgaaacttgaggagattatggtaaatgaaataagccactcacaaaaagacaaatactgcatgattgcacttacgtgagtttatctatagtagttgaatgcacagaaacagaaattagaattacggttaccaaggtctgggtggaagggggaaatggagagttgctgttcaatgggtttagagcttcagttttccaagacgaaaaagttctacaactctgttgcacaaccacgtgtatgtagataacacaatggtacacttaaaatggttaagatgcccaattttacgttgtgctttttactgtaataaaaaaaagatacagagaggatgtaataaaatgctataaactaaactagaaaaaaagattaagaacagtgttagtttaaaacaaaaaaaaattgctgattaataatcacatagagatctatgcatgaagtatgcattttttaaacaagggtgagctcatactatttgagttgttgtggaatttacttttctcacttcacaatatggtgcaaacatctttccttgcagttcagtggaacgtgacctcattctttcaaaaggcagtatgcaatcccactgaatgaaactacagcttacaagacccatctttttattgatggacatttctgtggtttttgctattacaaacaaggttacttgctattaattgcctcagtctgccaagtacagtctttaagtactgagtcattatcacttgattcacacctaaggctttgcttgccttcaaatatgtcctgcttaattctagtcccttgcttcacatacctgcaaaaatgatggtgtgacactccagctctgtttctctaatcagagtcctttgcacccacgttccctctggcaaaggtgttctttacaggctgtgatttcagacatgattttaaaaccgctgaaaagagcgacttttaggtccaaggtctataggaacccttattatgtaggaccttgacgcttcctttgtaagaccattagctatcacagagaagtagcacaaaggattactgtctaatacatttgtgacctgtattgtgtagattgcaattgcgtaattaaagttctgcttttgagagcttccaaattctcatgagccatattcctttttagaagcttaggccttagaatcctgaaatatgttttttcttcacacttcaagtctaccttgctaaaacagcatagctatctgactatgccaaacttattcgtcattatctagcataacatttacagtgacattttaaactaattagaatatgtgttttttttaaatactaactaaaaatatagaatataaaatgtttatcttttattaatagctataattccttgtaactaacctctatctttacctaagtaaatcgacctaaaatagtttctttattagactgagccccatgagggcaggaatcatatgtatctttttcactgccctagtcctggcctttggcagagtgccacggagtagaggcatcttataaagctgtcgaatgaattaatatttaccgatgatagggacaataccaaaattgtaatagtgttgatgtgagaagcatattcatatgcaatcatacaacatacacaaatgcacactgtgagcacatttgatgattatgtaatataggtgggatgatttcaaagacagcagagaggaatcttcctcttggcctgctgaaggcttaaagcacacacttagagacctagtccttttgcttaagatttcatcagcctggtaatctgtagatttcctaatgaaagacagcacatagacttgtcttgtttgtgctctgcatgtctcagtatgaaaggatatgtttttactgtggtcaggatttgttaataaccacatgggcataattaagagagaagcatgtggctgggcgtggtggctcacccctgtaatcccagcaatttgggaggtcgaggtgggcaaatcacctgagcctgggagttcaagaccagcctaggaaacatgatgaaaccctgtctctaccaaaaaaaaaaaaaaaagaaaaagaaaaaagaaaaaaaaaattagccaggcgtggtagtgtgtgcctgtagtcccagctacttgggaggctggggcatgagaatcgcttgaacgtgggaggcagggtttgcagtgaaccacaattgtgacactgcacttcagcctgggtgacagagtgagaccacgtctaaaacaaaaaagagagagagggagaagcatgagagctgggcacccattagacatggtctagcatcttcttgagaagtgaaggggacctgagaagcttatggaaatattttcctaatttagtctttcatattggcccatctttgtgagaatttatatgtgaacatatgtcaaaatggtggcaatcatgtcaaaaataatagaaacatcttagcaggttgattatttttgtagacttacacgtagtaccttgaagacaatagaacgttatttaaaaaaaacatttggctcagtgttttgagcttatatattctgtcaataatgggtggtagagaaatcaattaactataggtctcttatacacactctatacatgttgtccttcacattaagagatgatgctatagaaataagttttcataatgtatgcacatgaagatatatgtataaatacaaattaaatattctatgcatgcatagaaataaatacttgatttcctgttaacaataataacattagtaataataataatagctataatttataagaatttgccaggcactttaattcccataactagcccatgaaataggtattgttatctcacaaatgtggaaacttagatttataagtattaaacagtttaattattcaaaatcaagacagctggttaagcagaaagattgtataaatcaaagcaaggtgtgaatgacaaaaattcacggttttattcactatattatctgcctctactttttgtagaaaggcttataatgtagaatttaatctagctgtatgaaaacaaaattttgttacttttacttgttcaatgtcctgttcttagtgccaatatttaaaattcataagatctgtgttctggtttttctctggttttggagagataactgtttgatatttcatttgattttcttactttttattttaaaataactttatttttaaatggtcaaaatgtgattctattttctttcctggaaatgctcagttttaataagtgaaatggattatagaactcagcgaatcacttaggaaaactgcttgacagttttgagcaaaccttgcgtaacttttatgaaacacctccagtcagtttgtcaggtagaatttcccaagcacagtcttttttagattccgttgattccatttttaggagagcataacagtaataaggcattatcccgcaatgtgaaagctcttctctcttttcctttttaattgaaggatcaagtattcacacagggagatatctgccacattcaatcagcatctggaccttgaggggagccctcagttcatattcctattgccatgctgcactggaaaagacaaacaaatatgtttggagcatctatattcactacacatgttatttttatgacacactaaagcattgttgtttaattcttacagtaaacacaattcttcagcgtaaatagagataccttgtattaaatttacattgtattgtacttgcattgaatttccttggttatatatgacaacctattgagcaccttaggaaatacaatttgacataacatgatgaagaggcacaaagatatatatcccagtggatatgctttatggacaattatcatccagcttccctgtgaaaattaaacaccttaaaaaccctatcattatggaaacagaaaggtgataaacttgaaactccttctgttgtacagccaatgggaattaagtatccattttgtggattatccattgaagaactgaatgtctagaactagattaaattaaactgaattaagccagaacctgaccccctttgccacatggcatgttacagttttattttgcttcagctgtcttactgattattagtgccagagaataagcaagaaaaagcctgaaaaaatacaatatggtacaatataatagagtaagtgattttttatggtgaatatttctcttttgcttttctagattcactctttttcaactctgccccgtgccctgtaaggctgaaccttcctcacagtggcaatgggcttcctctctctctggcttcctgttggtttgtccatgggcagcaacggcaaaagatgagagggtgagaggagcatggagtctcagaactcattctccctggctctctttctgcatggctctggattccagggttgcattcctccagtaaaggctacatttcctatttgaagcctctttctttctccaggttcctgaatttgttctcaccctttcctctaaaaacataaagaagtttactggctcctagccaactagttaaaatggtctaggaatcttagctagtactagctgggaatgctttattgtcactggttgctttcccttaaccctgtccgcatctttgtaaataggagttccactaaaatcttttccatgccatttgagttgtcattggtttcctgttgaaaccctgactcattcctaaattttatttaatccacatttaacacggagaggtgttttttgtgtgtgtgtgtttgtttttttgatgggggggtagtgcgtgaagataaatttaaaatgactttcttcatgctaagagtggcaagaataaataagtaaatgaacaaaatttccattttcttaaactttgtttcaatacaatagacatcttaaaggccaataagaagagccaagctcaaagattctagtggcggcttgcttatctaataaacccatcatatttaatttttcaaataataatcaacttattgatatatctttgaaagcttttcacttattgttataaaatatttctttgttatcattagtgaaataatggcttatgacatcttcctcttgatgaagtagctctgagtgccaagtttagcttataggtcagtttcggccaggcgtggtggctcaagcctgtaattccagcactttgggaggctgaggcgtgtgtatcacctggggtcaggagttcatcaggagttcaagaccagcctggccaacatggcgaaaccccgtctctactaaaaatacaaaaattatctgggcatggtggcaggtgcctgtaatcccagctactctggaggctaaggcaggagaatcacttgaacctgggaggcggaggttccagtgagccgagagtgtgccattgcactccagcctgggcaacaagaacaaaactccatctcaataaataaataaataaaattaaataaaaatcaaggtcagtttctcagataagccctattacgtatcctacccagactaggttagcatccacctctcccttctctatcccatgttttccttctatccatctgatttttaaaaagtaaactttacatcctcataatacctctaatgtctgttctttcgcttagattgaaagttttgtgaaggaagtaaccatgactgttctgacaacttctgtattaccagcatgcaacacaatgtctggctcatagtagctaccccatagttactgatgagccagatgactaccagaaaccaaatctaaatccagcagacttacaaaaattattttacagtatttagtaaatacttgtttctttgcactttctggacttcattggaaaggaatgaattttaaatgaaaagatagcatacaaatataagaaactattggctaatgacagatagtgtgccacggaggaatacagacctgcctaagcttgtttttgagagatgttagtttagtttttacaagagaagtgcagcacatgacataggtcagaattggaggagatagtctaaggtgagcttcctatagcaagtaaaactttaactcatactagaagcaaggggacagttctgtgtgtgtcccttctatgtgcacagtgcttattactaaagcacattcatatatgctcacttgtttgattctcagatcaactgtcaggccaccagggcaaggaatattaccccattttgttggtcaagaaatgaaagcttagtgagttttgctatctaaccaagttttaaaggtacgtggtcatgacagaagggctgaagtggttggaggaagatccctgaaaaagaagacaattggcttggaagcttttgactttgttttgaaatagttcccagaacaggagacgcactcaagaactaatttgttgattgaatgattacttacgtaaatgtatatgcacaaaattgatacttcaaaataattggccatacaatttatcctgttctgcaacttgctttttttctctaattcacatggagtaaacatctttttatgtcaatagcatagtgctccctcatttttcctcaaagcttagtaaaatgccattgaatgaaaccacaacatttatagaggctatctggtaaatgattaatatccattccttgctacagctacatctcattaatgccagctaaccattaattataaaagatgttgacaataaggtttggtgcttggactagtagatagtcctcaaatggattctcatttatttggatttggtatactccttgaggtagtgttgcaaggagtgtttagccaatagttatatcctgaggagtcctcaaggcctgaggagaggaccctgaactagctgttaagcctcctcctctaaaacaaagtcaaacaacagggttgaaagtcaaagaatgaaagagaaaagaaagctgatgtgcctattttaatatcagacaagactttacagtgagtagtattattagttataaaaatgtagtttcataataataaacgagttactaaaattaacatttattttttatcaaaatatactataagggcccacaaagataaataataagagagatgatatttagaacacatgtaaccatcagaaaactgtatccagaatatataaaacatgcctacacatctataacaaactggagttaacatctgaaaagtcatttcacaaaagaagaaaaattaaatgtctgataaacataagaaaatgggccaacttctgtaataatccaaaagtaaaagataatacccaaacaagataccattttttacatctaatactggcaaaaatttcaaagtctgacaataaggtctttttgaggatatagaacaatgagaactcacatggactcacatgtacactagaattgacatactttcaaaaagagatgagcattgtctagtaaaattgaacatatatcaacaattcctctccaggacatttgtcctagaaaatttgtgtatgcgcttcaagacacatatacaaaaatgtgtataattacattgatgtcatagccaaagtataaaaacattctaaatatctatcaagagtagaataaataaataacatttgccctgtaggaatactacacagtaatgaaaatgagtgaagtatggctactctcaaaaacatgtatagaacacatgaatatcatgttacacaaagcaagatgaaaaaattatatatacaacataactctattaatataagttagaaaaccatgagaaacttaattatgttgttaagggatgcatttctcagtagaaaagcaaggacatggttcttcaaaagtcctcatatttatctgtgaggaagggaaagggatccaattatggacaggagatttctggggtgctggcaacattctattttttcaacgtgagtgatggttacatggccttttgcttttaaatttgtcattaaaatagaattgatattgtatatatttttatatgttatgttttattacgtgatttttaaaatgtagaaagaataggtatatggaagccgtaaagttgtatgcactgtagagtctgaatgcttcagtgccgacacatagctctaccacttcctagctgtataacactggccaagttaccaaacctctctaaaagcttttcttgtcatctatttctctcatctaaaatagaacccattccactatcaagagtttttcctgaagattaaatagtacttgattaaaacgctcaatccagtgattattgctttagcataaacttctttggactttaaagtgtttgtgtcttcttacctggcatgctcccctgcacaacagtattttttaatttaaatattttattttgagataattacagattcacaagaaattacaagagacagagattccatgtatctttaattcagtttctcccaatgtcaacatcttctaaaactataatacaatatcacaactaagattttaactctgatataatcaagacacagaacaattccatcacaagacatggtttcttcttatcctcacactgaaaaacaattccctttttaaccaggaacagaagggtaagttagtactttggaagtaggcttttatgagattaacgtcattgttcatgtttgataaaggaacactcttttctgaatagtgattttatcataccatattgcaatctaacacattccatccctaagtgtcacaagttttttttttaattaaaaagaaagtatatataactgctaaagatatttcttctgccacagactactgctgaaatgcagcattcccacatccctgcctcattcacgactacttcctatacattcaggaaaagacgtctttaataattatttttcctgtttgatatttttaaccatctcactgttactacctgcatgggcttccctactccagtctattttacatgtgattctagattattttttctgtatatgactttatcttgtcgctagtcagttcataaaaacactaatggtctcctgtgcatcataaaatcccaactccttgtagtgtcattcaaggccccaaattccctttgaagttttgttttctattagactttatcgagtgatatggtttggctctgtgtccccacccaaatctcaccttgaattgtgaaaatccccatgtgtcatgggagagaccccgtgggaagtaattgaactatggggggcatgtttttcccatgctgttctcctgatagtgaataagtctcatgagatctaatggttttataaaggggagttccctgcaaaagctgtcttacctgctgccatgtaaaacatccctttgctcctcctccaccttctgccatgattaggaggcctccctagccatgtggaactggggagtccattaaatctctttcctttataaattacccagtctcaggtatgtctttattattagcatgagaagggactaatacatccagctacaggaataacaacagattattgatctatttgggatacctttactgaaccttgcactttcttacttctaggcagtggcaaatgtcattttcctcaccagaagcatcttcctgagacataggtatttcacatattacctttcatgggagacttagcttcatcatatgacttattgaagtccccactaccgtatgtggaagacttgactgctctaaaaagcctgtaacacttctttagccagagtgattattccctgctagagggtcctgtacctactgtctactatttaattatgtcatttgtttggcataaagttgttgtggtgcttatgatccttgtttaacccttgaattgttatttaattatacctatgtttaactcttttcttacttccataaaggtagatattattcttattctgttcttacttcccaaaataccaagtatagtactttgcacttgattgactttcaatatatttatattaatctttttattaggcttatcttgattgctttgagaaccagagcatgttcaccagttcttaattcaagtgaaattcctaaaaattttagaagaggaaattagaccagaaacatataacaagagtagtgaccagagtggggtaagatggccagtttccacaactaaatttatatttgtatggccctgtaaaatgggttagcccctctaagaatccattccctcctctttacagcaatgacaacaacaattcttattttttggagttgtcagtgttaaagaaaataatgcataaaagcatgtaccctattgtctgtctcaaagtaagtgatcagaacattttaattttcttttttaagaaaggctctcactttgtcacccaggctggagtgcagtggtgcaatcatggcccactgcagcctcgacctcctgggcctgagtgattctgccacgtcagcctctcaaatagccaggaccacaggcacatgtcatcatgcccaactaactttttgcattttttgtagagacagggctttgccacattgctcaggctggtctcgaactcctagactcaagcgattcacttgccttggcttctcaaaatgctgggattataggcatgagccaccatgcttggcctgagcatattttaaattactttaaattattttgggctggtggcagtggctcatgcctgtaatctcaacactttgggagactgaggagggtggatcacaaggtcaggagttcgagactagcctggccaatacagtgaaatcccgtctctactgaaaacacaaaaattagttgggcgtgatggcgggcacctataatcccagctacttgggaggctgaggcaagggaatcgcttaattcgcctcctgggaggcggaggttgcagtgagccgagatcatgccactgtactccagcctaggctacagagatagactccatctccaaaaaaattaattaattaatttaaaaaattattttaagtattctataattttgaaaatacttacatggcatttcaaggactcaaaatcttactttccccagagctactcataaatcaaaactttgtttaaaataaatgaaaacagaggtacaacataccaaaatctctgggatgtagcaaagacagtgttaagaggaatgtttattgtgctaaatagctacctcaaaaagttagaaagatctcagtttaacaaactaacatctcacctagaagaacaaactaaactcgaagctagcaaagattttttttattactgattcaattttcgaacttgacattggtctgttaagggttttaatttcttcctgattcattctttggaagttgtttgtttctaagaattttctctgtattttctagtttgtgtacatagaggtgtttataatagtctctgaggatgtgttttgcttgtttgttgttgttgtttttggtaggaactgcctcccctaccccgccgaaaaaaaagaaaaaaaaaaaaactggaccaggtggattcacacccaaattccaccagatgtacaaggaagagttggtaatgattctactaaaactgttacaaaatatcaagaaggaaggactccttcttaacactttctatgaggccagcatctctctgatagcaaaacttgtcaaagacacaactaaaaaaggaaactacaggccaatattcctgataaacatagacacaaaagtcctcaacaaaatactagcaaaccaaattcaacagcacagcaaaaagttaattcaacacaatcaagtaggcttcattcctaggatgccaagtttggctaaacatatacaaatcaataaatgtattcataaatctccttgagttggaaatatatttaaaaacatgattcatcatataaatagaactaaaagcaaaaatcacacgatcatctcaatagatacagaaaaagctttcaataaaatccaatataccttcatgataaaagccctcaacaaagtaggcatcaaaagaacatacttcaaaataataagagctatctatgacaaacccacagccaacatcacacagagcaggtagaagctggaagcattctatctgagaacaggaacaagataagaatgcccactctcaccactcttactcaacatagttctggaagtccttgccagagcaatcaggcacaagaaagaaataaaagaaatcctactaggaaaagaagaagtaaaactatctttctttgctgatatgattttatgcctacaaaacccaaaagattccaccagaaagttcctggaactgacaaacaacatcagtaaagttttaggatactaaatcaatgtgtaaaaatgagtagcatttctatacaccaataatgttcaaactgagagccaaatcaagaatgcaatctcatttacaatagccacaaaacagtaaattcctaggcatacatccatccaagaaggtgaaagatgtctacaaggagaactagaaaacactggtaaaagaaatcgtgtatggcacaaatggaaaaatgttccatgctcatgaagtggaagaatcaataatcactaaaatggccatagtgcccaaagcaatttacagattcaatgctatttctatcaaactaccaatatcatttttcacagaattaggaaaaagctattctaaaattcatatggaacccaaaaagagcccaaaaagagccaaagcaattctacacaaaaagaacaaagctggaggcatcacattactcaacttcaaactatactataaggctacagtaaccaaaacaacatgatactggtacaaaaacagacacatagaccaatggaacagaaaagagaatctagaaatacagctgtgcacctacagctatctgatcttttacaaagtcaacaaaaataatcaatggagaaaggactgcctattttaaaaatggtgctggggtagcttgctagccttatgcagcaaaccagacccctacttttcatcatatacaaaaactagctcaagatggattaaagatttaaatataagatctcatattataagaatcctagaggaaaacttaggaaacaccattctggatgttgtccttgggaaagaacttatgaccaagtcctcaaaagcaattgcaacaaaaattgacaagataaacctaattaaactaaagagcttcagcacagcaaaataaactatcaacagagtaaacagacaaattacagagtgggagaaaatattcacaaaccatccatttgacaaaggtcaaatatccagaatctataagaaacttaaatcaacaagtaaaaaacaaataacctcattaaaaagtgggtaaaagacatgaacagacacttctcaaaagaaggcagacaaacagctaacaaacatgctcaacatcactaatcatcagagaattgcatatcaaaaccacaacgagtaccatctcacaccagtcagaatgactgctattaaaaagtcaaaaaacaacagatgctggcgaggctgcaaagaaaagggttgaatgcttatatactgttggtgggaatgtaaattagttcggccactgtggaaagcagttgaaggtttttcaaagaacttaaaacagaaccaccatttgacccagcaacccattactgggtatgtacccaaaggaaaacaaatcattctaccaaaagaaacatgcactcgtgtgttcatcacagtactagtcacaagagcaaagacatggaatcagcctaggtgcccatcaacagtgggttgaatgaaaaaatatgatacatatacactacgaaatactatacaaccacagaaaaaaccctgaaatcatgtcttttgcagcaacatctatgaagctggaggcttttgtactaagcaaattaatacaagaacaaaaaaacaaatattgcatattctcatttataagtgggagctaaacattgggtattcatggacataaagatgacaatagaccctgaggattaatggcagggaatggggagtaaggactgaaaatctaactgttgggtactatgctcactatctgggtgatgggatcattcacatcccaaacctcagcatcacacaatatacccatgtcagaaacctgcacatgaacccccgaatctaaaataaaagttggaaaaaacagctattgatacatgtcctgtgttctagttaaagaaaaaagcatcttcttaggcttcagtttaaaatgtccactacattatatttgttagtttttgttactctgtttaggaatctgaggtcaatgaagttaaaattgtcatgttaataggtgttttagacttaccgcttattaaaagtatgttttaaagctgaatcatacagtgttttatattatattgattttgtttatattgaaatcagcttaatatgatgtgtgtgtgtgtatcaatataatactagtcctacagtgtggttccacaattcatccttcagcccttcctccatatgctgtcaaatactgtttacctacaggatgccgggtaactctgtgtttgtgtgtgtgtgtgtgtgtgtgtgtgtgtgatctcacctatgttaaagttagacttcattctcatccacctctcaattagatacatcctggatactaaaaagtttttgagcagttgaattaactgtcacaaatatcacttaatttcattctcagcttatttgccatgtattcatcttagtctaagcccttctttcaataactgtctgctcttcctatatccatagttccagatgtcaaggttatctagcttctcaacatagattgctaagggttgacttactagagtcagatagacaaaaaaaaaaaaaaaaaagaagaagaagaagaagtaaatttggagaaactgtcactgagagaggatgtagaagaactcaaacaatgacacaagaattggtaaggtgcagtcactgagtgatgtttagggtaaaagctgggtaagaaccctgtatctcatcaatcactgaagcattatagaattagagaatgtagtctttggtgtccataatcaaagtttcagtcttcacaaaatgattcaattatattcattatattctgtgtgagaagacaggtaagtgtgtagaacttactagaaggatttccttcaaaagtggttaagatttttagagttcatacttaaggggatgagatttagtttcaatgaaaattaacttctataaaatatctcatttcccaatatgtcagataaatgagatattatgcacataatcctaacataaaagacattctctgttccccaattatgtaagaaaagggaactattgatttaggtactttgtatctcagttaaaaagcaggtcaaataggtagcatttcaagggtcttatggtttctttaagagattctgtaacacactatttgtacataagatttttttaggatcaactgactgcttcacagagagcctgacatgtaagaattttttggtcattgttattacctgatcatatcttttttccctttaaattttctatgtattataggtaggtggtgttttcactatgtgtctttcacttcttagctttaactcatttgtgtctttgtgtgtcaagtactacatagaattaaatcaaataccttccataggtattcataaagttaccatagatggtcacaccagaaataaagaaaaacagatactggcagccacatctttttgtgtgtttagagctataagtggtacctgagagtaaaataaaagatctttcccaaaaatttggaaataagggaaatggacttatcagaatggtaaactatacaaggttgtcttcttaaaggaaaatgaatcacagcagtggctttttaaaagtattaactcatttaacaaaaaatgctttaatcctaaatgaatgtattgtcctagatctgattggtataagagaaaacatttcagatattcaaaacagagggtattttatacaagtaggttgttctcaaggtgttgtaaagaagggctggaagaacaaaagggaaaggtggcaggtactggatggaagaaaaggatgattgacaggagctggtgcttactgctacacttgccgatttgacatttgaaccattatgggacgctgccccaaccagagctgaaatgccaacaacattccactaccgaagaggcagaaaatgcagaagagatgcttcttctgtctggaatgcttgaggctgcaggtgctttgtcccctgctgacacagcagctgtcaacaaagccctcagctcttggagctagaaactggacgttttctttcttcctgcttctgtcctcctcacagtgcctcccactggcaaaacccaatagaaggccaacaagcaagagagttggaaatgtagtttgtagtttgtaggttcagccgtacagaacaggctatagaagcgtggatgtgtagctggggcggacgtcagatgaatcaccttcttagctactcggcattcacacacacccttgtacttttcaccacctttcattaccaatagcaatcactctatgcttccaatgaacatgatactactatgctttgtacaaatgacggtgctctcacctccctcatcacattcttatctgggtgatgttaattccccttttagttcaggcacaacccatctggatattcttcaacataaaaaaactaaactataaattaatacccactaaccctatttacatgaatcaatggggaaaggaggacggaaaattggctacaatatacaaatctctgtgtcataagcagaaataaaatatgatagcatttataattcttgtttatataattagttgtgagaccatagctgatatttacaacttcttctctttgccctcagctggtagttcatttgtttgtagttcttttatttttattttttgtagagatagggtctctctatgttgcccaggctggtcttgaactttggggctcaagtggtccttctgctttggcctcccaaagtgttgggattacaggtatgagtcaccacacccggcttatttggaattttttacttaggccactggatcttcattactaagggggtctatgtccttcctgttctatcttgattgggttgctgcagattttcaatgcttatatgattggacctggtcatataaagagatgcccttttgaatgtcctgactgacaatgtgcagtaggaagccagtttctcctccaatatgataccttttctctttgcctgttataggaatgctatgaagagagggttaaaaagaagccaatgtgtaccaggtgcttagaacagtgcctgatacattatgagtcatatagaatgcattaacaaataaggtcgatttacttctggggcatatctattaagaatatcttcttttagaaagcaatacaaattataagtatgcttcacttattaatttttgatctggaacacacatgacaacagttaacaggatgcaatagaaagattctcatgctggaactgttgggttctatttctgtctctgtattaattaggtttacagtttgatattcaagggtaacatctattttatcctttggtaagagacagagtttagacaaggagaaataccagagtctgtgatttaatgattccatgaaactagaaatcacatcaagagtgcttgctttcttaagaccttctttgctattgtctagtagtcatactgaaaggcaattattatcttcccaggtgttatcacgagttatggattatatctagatggtatattaatccacaattcctcagaactcagctatcgtgcttacggatttgctccttggagtttacattccttcagagtccaagcatgcacggccaaaggttgtgctctgggcccactggtgagtatctaaatttacattctaggaatgtgttaaatgtcagatgacactgaatattaaggaagaagtaagtggcggtgactcaccctctgcacagctagcctttcaagcaggatgggagatttttctttttataaaagttcatttaagagttactaagattttatattcgacataaatttcaagactgaacataggtccagtgaagggcagagtctacattttattgaaagaaagataagttggctagtgtagtaggcaaacatgaaatttttcctaatttagtgacatattgaaggcagatgtttttctttctaatcatgggctcaacatctaagtaagtttaagattaagaagtaaaaataattgaaagtccataagtgccacaatatggcaacactgctccccaaaaagtaatcaattaaaaggttgagtttacctcatctgttaggataaaatagtttcatgtgatacagcttcataagaatggtatttaaaattacatcaatatcagcttttgatattcatatttcagaaatctatatctgaaatgtatatctatatttcattagcagttaacagcttgacaagattatgttttctattcctaatataatttttcaaacccaattaatagcacttaattatcataaactagcaggacagtcttcagtttcaaaacatcacattacactttggtgcatttttcttgattaattagattttgcttctttagatggaaatgctcattagtcttagatattttttggcaatgtttgctaatgccctatcattttagtgcatgctgtcttcactgaagagtatattatataaatattaccttggaagacagctctatgttttaatttctgcttccttatttttgatcacacctctctttttgtttcagagattggttgctttccaagcagctaacaccatccatcggcggagctgagctgtagtctttattgccattaagcattttatagcccagacccctctgatggatacttacccttaaatgcaggaatggcaataggccagcttttcttatccattcaaaaaaaaaaaaagaaaaagaaacaaaagaacacgtcacatgagattgaaatttacactttttgaaaatgtaagctgcaaatggtagttctggctacaaaattggctcagcggtgtctcctgatgttctggcaactttaaataagggggacctgcattatcaacctgcatcctgcacagacagtagctacgttaaccttaagaaatcaaatgccacaaagctctgataggaaggggggaatagaattgggttgtaaaacctagtctgccatggcttcattcattccagactcaatcctgacttacagcacagagttattttctcccttggtacttttctttatgctgtactcagtatgcaaacgcttttccctagtcaatgatccatctctaatcactgggattgaagagcaatgtctttatttagaacaagtcaactatatgctaccaagaagttaaagcccatggtcttcaactggtttgtgaaatatttttgtgcccattaagtgattccatatctgagtattctaaatagccctggatggctagcacaatcatgaaggatattacagattcagcttctttttgttgatgattcttttaatgtgtccttattgacttaagaaatctatgaatcaatcttaaaaggcagagttttctatcattaaattatgatgtgatactcaacaaaattcagtcaaacgtggcaatggtgtacaacggtttcttaagatattcatctaaatagagcccgatgctatgacattttaaataaaaaatttcattgaaacagaaaatttatcatttctatttttaaatattttgctggcagaaatcagaataaattttgaaagagttcaatttttttgttcatctaatatttcttaatgataattcttgttctttagattatccacacatgcagggaaatactattcaatgttttctatgaggaatatgcttcacagtcccaaatatgatatggttcatcctccaaattgcaaattgttcatataataaaaaatatgaatttgatggagaatttttaaaaataaaaagacatacagaagttccatattcttaccacttgaatgtagtattagctcatttttttttctaatctgaccagtttgttagctattatttatggttcagaaggagttgccctgtacctatctggaaaaaacaaaaacaaaacaaaataaacagcagcaacaacagcaacaaaaaaaacccacaatgattctcctgtggtttttttcagttcttactcaaccaaataatgtatttgactcttatggaaatttcaatatagaaaacaattgacaaagcctttgaacctaatttttagatgctaatgtgcattgtcaagttaaattcaataaattggggttttataaattttgaaataacataaaaattaacagaatgcagcaggaactttttaaatgctttccttgctttcaattgtattagagggaaacccttcacattttgtaatattctttaataaaatacaataatgttttccataagaaaatcactttgctttcttactccccacttagccaatgttacataacactagtggagtctaagattgagaattttatgactgtgtcttgtattgtaacattcattggatcgattctccagggactcttaaggatgatatgcgagactataggtcattgctatgtgatatggctaaaaagttgtcttggttccttagtgatgtcatacttatacagataaatacacctggataaatacacatgtacaaacacattcaccctttcacattttttttttttgcaaagaagcaaataagtgtgttatttaagacatctaaatcttaatggcaatatataatatagtcaagcaaacgctataggggaagtctgccttcaacctgcttaaaccccttaaatccctatacccccttaggagatatacttattctacaaagcctcagatttctcaactattacaaagagaaataatgtctactttaagagagttggtgtaaaaaattaaatataacttacacaaatttctggcgcattgcaagagttttattaagaataacagtttatggccaggcatggtggctcacacctgtaatcccagcatgttgggaggtcaaagtgggtggatcacaaggtcaggagttcgagaccagcctggccaatatgatgaaaccccatctctactaaaaatacaaaagttagctggatgtggtggcgggcgcctgcagtctcagctactccggaggctgaggcaggaaaatagcttgaacctgggaagtggggattccagtgacccgagattgtgccactgcactccagccttggagacagagtgagactccatttaaaaacaaacaaaagaattacaatgtattaaagtgtttgtatgttttattgcacatttgctctcaaatattttttctgtgtcaagagaggttcccaggccaaagccaagccaacttttacctttcccaagtgccttttccacatattccttttacagcaaggtagataaacaaaaaagtaaaatgaaaaagaaagaccaggtcagagcaaaatagtacaattgccaaattcaatgtatagtaaaaactgaagtgtttatccaaatatttaaggaaatgttacaaaacatatttattttgaattaaccaaatatttgaggattataatataattatctggaattgcccttaattcttcaacttttcaagtctcattttatttggaatgctttaaaatcattctatgtacaataatatgaactatatagataggcataataaaacaaattacattgtcataaaatattaaaatgatgaattgatatttttctggcctagtttcatcatttttgtatgtagctattaaactaaaaacgaaagagcaagtgttatagttctaaagaatcccatagcttttctctgatgaaaataaaacatgttgtgacctcatagttattaaaaattaacactttctttttcacatttattttcataattgataaggtataatcaccctaacaaataaaggttttctaattgataatatttctgcctaaggatttcatgtttgatcacctccttgggaggcaagagcttgtaccttaagaataaagttgaaattatcacatatttagtaaattgtgaaaggtcaaatatctatgagtgatgctgatgagtttgtagtgattagttaactgaatttaagctaatgattaaaagatattaaaaatttctgaactcttttctactttcttgccaactacatcttcctctgaccacttattttacttatttatctattgaaatcttcctgaccccggtacagctagggattgcattttatttcagagtctttctcttcaaataattcatcttttgctcttttctgcatagcttcattaacacaatcaatatttttttgtgattgtgccttagggatagagtccctaggatgcatgtatttcttaatgttagcatgatgccatttttacataactgatagcaacatagctcataaaaattttgcgtgtgtgtgcgtgcatgcctgtacacacatgtatgcatgcgtgtgtgtgtgtgtgtgtgtgtgtgtgtgtgtgtgtgtgacagagaagagagagagtcaagatatgtggtgtagctttttgacagaggccagaagtctaccacctaagtcaaggacttataaaaacagactgcgtgcatttcttctcttttgcaatcacataaaaattattttaaagcagtcctagaattggtctatggatatgtacagccataggcacagtcacagtgtgagcagatccacatattctggaaatcacaaatagctgccttggtcaagagctcaaattctaagctttaacagcagggggaagaaaacatgaggtgtgctttgatcctgctgacaaaatgaggtattcatacaagatgctactgtcaaaatagtttacttcacagcaaaaagagattctttgaagaaatatgctcaaagcgaagcatgtacttattttatttgcaaacaaaaataaatctttttatactcacaggtggaaaatcgaactctagaagctcctcctgaaggaacagtaaatgtgtttgtcaaaacacagggatcccggaaagcccacgtgaggtgggaagcaccttttcgccctaatggactcttaacacactcagtccttttcactgggatattctatgtagacccaggtaatttgtttttattttctaaactttaaataacattagaaaacaactcatttttatttaaaatctttcttttggctaaaatctttcttttagccacagatgttggtttctttattttcctgaaaataacctatacggataagctactgcccgacggttctcagaatgtggttcccagagcagcagcaacagccacatctgatgaacgcttagaaatgtacgttgtagagcttctgccccagcctagtgaatcagaaactctagaggctaaggtctaacagtctgtgtttaagcaaaccctttaggtgacacatgctgaagaactagtatatactcttcttcccttgctaaaaagtggttcaaacctaaaacatcgtgtatgcaaagagttgaactataattttgcagtccatcttaaacaagccatttttgtgactgttttagatttctgaactatcttagtaattctgctgtgtgttctgataaatttactgaatgtggattaggctacatggggttccttgaaagtattttcaaaaactatctgattcaataagttaggtgctatggtagcatgatgtttattttaagcaaactctaccataaaaagagcaggtatatattttaatagaaactttggatctgtattaagtgctgttgtttatcatcttccaggagtggccttactatttttgtaggaggaagtttgaacctttatttttaaatgagtagcaaatatgcaatatcgtggattcagtcagacatgttattagcatgttagtctgttgcttaggcttgaaaacgtttctttgtttctgaattttctatgagtctttgtaatacttaataacatcctccaagtgtaaaaacaggtgaagaaagaaaaaaacaggcttttctaaatttgaaaagggtggttatttgtgtactgcactggcaagcaaatgcgagtcaagtgcgtgtcagagtctaagctgatcccctcaaagattggtgtgtcccttttttatgcaatcagggctttcatgtattctgctgtaaagcacttgtaagattatgaggtgaaggagtgatgatcgatttgaaaaaagaagcaacatttaggccggacccatgacagcccagctatttccgccaaggcagctgggtgaataatgcaagagccatattccccctcgtgtttaatcttgcattgtttttgcagagaaaatttctgcttgccttctaagtcatgtcatcttcagttgtcatcccgtctctcaaaccatcaaaacggtattaaatgttgcaaagctgcgcggcaagagaactttcaaaagtcagaacccatttaccgaacagcccttgtagaaaatgtattctgttctcggcagaattttccttcagttctttccactgagaagtttactgatttctcccagtggaatctgctggaatttatcggttcatggttggcagtcacagattaaggtaaatgtcgatccgtaatgaccctctacatgttagtattgcagtaaagctgggcttttatgtcaaagatatcggagagggagctattacacatgacaggggtgatcaagggactccagaccaaggcaagcattattaaatattgactagttctgtgatttatgtagagctggaggaaaaaagtgactttttaaccattatatattcttcagcaacgaaaaccagccatttatctcctgctggtaataaagaacagagtgcctgcatattttagtggagggaaaacctggtcttataaatgagatgaactccttcgtgataacatttcagtttgttaattgccaaaagcaaaacagacaaattggaagcaattacgagatttgacttaaagaatttttgcggtacgggttcaactcaggggttggaaaggggtgaggttggaagcaaaaggagcatctgagatgggccccaggaaaattcgtgtcattggttcactggcactggaactctcatgtccactgttaactgaaaggattttgaatattgtcttgtcctgtcacccatcagcagctgggtgacatttacactgagggtagggaggtctgcatggctctacaagaacaaattaaacattaattcatcaaacttatttaagatatcatctgttcactagatttatacaaagcttattgaattgtctaatggctaattggttatttccttgacataatgaacaactgtatttcatcctttcctgtgatggctgctaaagagggggtggttagaatttataagatagggaaattcagctagttcaaagcaagtgtagtttcaacataaaagtgcctgcagctgggtcactattttgcaggagaaattgggctgtgtctgtaagacaccctcatgggaaccctattcttcatgtcaactcgtatcctgaactaaaaactttacaaaaacattaggtttcgtaacaacaagtgaagtggcacgtatcaaagtgtgatttttcttaaaaattgttcacttttgaccacgtattatgttctcatgaatcaaaatttaaaagatagaaaaaaaggaagtaaagtaccaagcctgttctgcagtctcagaggaaaagtagtgtgctcagcttcttatatccttctagaaatatttgtcttataggtgtgtgtgtgtgtgtgtatacataaacaaacacatatttcccccatttgtaaatacatatagttttcatctcacacatgcaacattttatactaatgataccaagtggtacacattattttgcaccatgctttttttccatcttaataatttcagagaaattatcacagcaattcctaacgagcttcctcattctttatatagcttggtaatattcaacgggttagagcataccatcattggtttaaccagttccttattaatggccatttaatttgtttctaatcttttattatttcaaataatgcctcaatgaataaacatatgggaatgtcctttcacactttgcaagtaaattaatacgataaattccttgaaatgaattgccaggtcaaggaaaaatgaatttgtaactttgtaagatactgtcaaatttcattccatagagaccatataatttatattctcagaaaaagtatgagggtgcctgtctccccacagtcttgtcatcagagtgttgtcagacttatctttgccaattcgatatgttaaaaatggtagctatttcacagtatcttgagtagttattaggaattagttggaacttatgaacatattttcttaagtttaaaaactgtgtttcttttttttgtgaatgcttcatttgtatcttttgcccacatttttacagaggtttaagaagttctttatatattaggaaaatctgttatattagtagaaatttttcccttcattattgctttttcctagcactctactgctttcttttataaaatatttatattcagttcatctgaaatttatactgatataatatgtcatgtatgggtcaaaccttattttcttcccagaaaattttcctttctctcaaaaccatttactgaataatccttattgttccccactggcttgggttgtcatctccaagagctcctaaatttccatctttattaataaatacgtgtggacatatctgtacctttatttacattatcaaggtatcttaatgattaaaactgtagaatatattttattgccttgtagatctagtcctcttcattatttttattttatataatttcctacttattatttcatatttatttttttcaaacaatatttatatatttctaattttaccccagaagtcctgatgctgtttttataaggatggaacagaatttacaggtgacttaggtagaattaatatctttatactgtcgggtttttctgatcaatgatatcattatactttctattttgtgtcttttgtgtctctcgcaagagctcaaagttttcttcatatagatcttgcatatttctgttgtgtattcattaatattttataattatacatgatttaagtaattatgataatatatacattttacatattaacattaaaattaaataactgaaaagagctactttcaataattatatgtagacttcactcgcagatacctgtcttctgaaagccacgattttaaatgtttatatctattagatgatcgttcatctaacttttacaaatatttgaagtttttttgctgctaagattattgtcattttctctaaaatgcaggcatcttaccaggggaaaatgataatctaattaattagactctcaactagtttgtggtgtgtaaaatggcaacaaaggttggacctgaagaatctctgtcctgacagaatttacaaataaaaaagctaaggcagacaaacttagccaagttattctcaagtgcatgaggcaggaaagaaactagatggtgtgacaagtggaacagaaataattaagggaagattttggtaatactgggtctttctctttaattatggatgagaataaactgaatatggaaaaactaaagagaatgacggagagagcacaaacacatgtgaatggcaaaaattaacagatcaaccaacctacacttggttatattagaatgtatttttgccatttgctaacatccaccataaaagtaaggattagcacttttctatgggattctacctgatttgaaacatctattcaattatgaggaacatatgatcaacaaattagtttttctagggtgtgcaagtgccatttactgacctggaataagtgctttgctcaatgactctcaagggtgcaccattcaccttgcacaggtgaatagtcaactcccagtgatcactttacaacatcttcagtattttttcacacatatgaattaactatcaatttaaattatagataacaggtttataatcattccttgtgaaacatattgaatatataatttttaaaaaataaaacaaatgtgtaagtttgggaatacaaataaaactttacagcatagtagtagcaacctggcttatgtaaaactatttataaaattataaattctattccatttaactggtagatgaaagtattgtgccatgataatttagggttacatcattattttacagagcttcaaaagtattctcagctacaaatataaaacaacctaattgtcaagaagaaaaataaaaactatgaaaagataaagaaaatattctgagatcctatagaataatttttacaaatggcagcttctttactactagacttcccttggattcttcacactgatcctgtacttagtagacaatgccatgtcttagtacacatatcctgcttttttcttaagtggttattgtggagtcctctgcgaattgtttaattcttcattatccttccttttgaatgaattgggacgtgatcttcattgcttgatatcctgacagattgctttgtgtcagagtttctaaggcaaggcaccagcgtgtgctaattgctgagtcctttgtgcactgttaactctcacctgctctgaaaaactggattgcagcttagttttcatcttcaaatgtctctttctcctaatcccctattttgtgctgtgccacagaataaagatatttatttgaaaaagagagatatggattactgtgggggaaaaaagagggtaaatgaaaatgatccttaagcattagcaaagggaaatggcattttagaaaaacaaaagaaaagcaaagcagaatgatcagtttttaatgttgaaactgaatcatttcatggatctcagataactctttctgaatgtggagaggtacaacaaacaggttttaggtgacttttcccagagtaaatatgtctaatccaaaataagtcctcaaaagtaagggtggaaggtaaggaccgggaaagaaaggaaatggaagatagaaagaacaatttttaaattgttaaatgctcatgaaatgagcataatcagatgctttttatttgcttataagacctgatggtcctgaaaaaaagaaacccaattagtatttaagaatgtttttaaaaaggcaaatgaaaatttgggaaatatatctgttatctctaggtggttatattatgaatggtttgtcttcccatttttccttttatatgtactcaacttaaaaaaaattctataatatatacatattatttttgcaaaacattataaaaaatagctcacaagagcagatgattcaagagcagagtaatttggagtaagcatggtgcttctggctccaaggaggagatccgggtggtgagtcagaagtcctaaggtggaagcttacagaaagaagggcatcttcacatatttccaatgattattcaggaaaagtcttttggtgacttgtgggatgttaaatttaactttcttcttatgttttggctgcatatgtttttccaacagttgctaggggtaatcaaacaaaaacaccaaggattctgcaaaacagaaaagaaaactaaataggagtggtcagagaaataaaagagcctctttatacctgagacataatggtagtgttaggggaggactgaggcatgggagatttggtttttttgaggttacattgtggggatcaggaggggcataaagtttttactgcagtggtaacatctggaaggagtggggtgccttaaagaccgattaggatatttccaggtagaaaagatagagtataaatgtgatggctccccatcccccattctctgagcctaaactttttcttctgttataattggagtccatatctcatttcaatattggtatcaagtgtttgctctttgggataaatccccatctaaaaacaaaagaaattaaaggggaacggaaactgcagaaatgcagaaagtatttcattgctggtttaaactagatgaaagtgtatttttaactacagttccgaaaaatcctagcacccagaataggcttaccttctcctggaattgccagttaccagaaagagtgctttagaatgtcagtatattcaaatgctctaaatctctaaaaaatcttgaaaaaccaaagaaatgcagttgatttttcaaggttacccagagaaatccagtgtccttttcacacactctggttctctgggtgcttttctccccagaatatactgtgttttataaaaattacaagatggaaaaaaaatatacagaagcgtttattttcttgagaaggtaaggaaaataattatatgtgggaacctcttagacttccaaagagtctgtaggaaggctaatgctgttaggaaagggacagctttgttttatagtccctggtatctgttttttagtgtggagggaaatctgcggtttcagagctgtgcttgcaacccatgcagtatatctgacacgctgccctctgggaaaacccgccagtgggggaattgttccagtgatgcagtacagcttgtaacttggaatcccgtcggagaactttgtagttgcttgtcagtcagtgggaagataaaagaggcagcttcttttcaagcaatctgaattcattttcccgtaatgagttagggggtcaggcagcaggagtgagttcacctgagatcttataaagtatatttcctggtggaagaaagagaggaggagaaaagggaacataacgtccaccacgcagctgtagaacggcgtaatgtggcttgtcgttggtctatttctttttatgcccacatattctgatttcagagcatatatttttagaaagaaaggtcaaagaaagtacagctttatctcatttaaaaatataaaacccaatctgtgaaaattgaaacccagttaaagtctaaagcagcaagtgatagtgtttcatacacaaatactcatcaagcaacaacatgttaaagatattgtactatgtcttctgacattacatcattattaaccacacaatttattttagagacttagaagaaattaaatgagtgtcatgataaggagttcttttagttacagacaacagccccagacctctcttcctgaccatttcagatgttgtttctaaatcagcacaaaagatattaggaataaaaactgtgggagaatgttcttatggtcaaagcaagtattaatataaaaaacattgggaatgtaggggaaatagagaaaattactctgtttctatttgtttggaagcaaatgtctcttatgcaaaaaagaaagtatagttattatatctttctgtaagtttccaacacatttctggatgtataaatacatacaaatctaaacacttgggaaatcaaaaggcattttttctggactacaaattatggccatattgttaatgaaaatataaacgggcaataataagatatctgtcatttcaaatattgggctatagaatgtatatgcactgaatgtattgacacttctgattgtatatcatgtcatggccaataaagctatagaaatgtttaattaggacatattcttccacaagaatggagttaagcattaatttatcaaacttgtttaagacctcatctgttctcaacactcacacagcagcttattgaatttgtctgatatctaattggctattttcttgacataatgaacaagtgcatactctatgctgttgtgtctgttgaggcggcgatgtaatgatgaaatggaaattgtaaccatgggtcgtacactgattcaggatatgcagcccacagagccatgagagggcacaggatttcattgtcctcatggcttaactttatgtttcaaactctgcagagcatctctgtggaggaatctctccattctaactcctcatgaaaggagcctgttagaagcaaaatacaatcagcagatcacccagatgatgtacctttggctttggaaggctttgcataatttaaaaaataaaataaaattctcctatttagagaaatttttaaagcatttaaaaatactcacaccattttcaaacccacaccacaagtgatttgggggatttctaatacatgcatgataaagttcaactggataagccagccgtggggcagatatataatgtttacctatagttgtgtaccactgatatgcctgtctagtgttggtttttgcatgctttgttgtggcaagagttcagtgcttgttgaataaatagtaatattagaatcagtgtttagattttggtagactgaacatatagccattttacctaggaggttctcagtaggaaagtgtcagctgtgaattgatgttagagggaaacagaagaatggattacacagagaaatagaaaaaaaatctagccatctggggccaatgtccttctctagcctctaagacacaccctacagcaaggaattcccttctctgattcctgaacttctcctgtgggaatctagggatcaacttccttggatggtgatgggtccttatcattatacagagttatgaggattacaaaccatatgtttggccccttagaaagtgataataggtgactcctaaatcatagttctatataccaagaacagcccacatcaaacatatttcccaaatttttgtgtgaaattcttcataatcaatgtgttactttactcaattattagtgttgcagaatctaaggattctagtgggctatttatgaaaaaaaaagtatatggcttttagagaatttggattctttatttataaatcgggttgcaaataaaatttatgtttttccttctagcaatatgcctttggggagaagcaaagggagttttacacccaagaagcagaaatcaaaaatcatagaattaaattaagaaatttatttgtttatttggacattcattcatttgttcatgtagaaagcatgtatctagcttgttttatggaacaagacagaaactaaatgatagctgctggagttgagtagagaaattttctctatccagagttgaatcatatgttgttttattgtgctaaatttgttagacatttaaatttatacgaatgatggtgcctgtttctgggatatttattccttcccattgtaaacctatttctccaaatcatcactatgctaacttaatcactatgctttcaacatctgaaacatttagaaagtacttaaatatctggcaagcatggtctgtgtgctgaaggggcttgtggtttaacaaggggagctagaaattacccaagtaatcatatagaaatataaaattacagactttaataattattaaagtaaaagtatatataactaagattttcataataagaagcttaatataaattggagggtcaagaaagtttctttgagctgatgacatttagggtaactgtaacatgactagacaccaactcagaaactagaaagaggattccaaagtgaatggcatttgtaaaggatgtgaggaaggtaaaattgtggtggatttgaggaaatgaaagaaggacattgtagctaggctagggagtgaagaaaagaatggcacagatgagactagaaagttagacaggagctacttcatgcagcagactgttttaaggactttggcataaagtaaaagtgtagttgcaataattacaaaaaattttcaaattttcaattgtttttttttattattattatacttcaagttttagggtacatgtgcacaatgtgcaggttagttacatatgtatacatgtgccatgttggtgtgctgcacccattagctcgtcatttaacactgggtatatctcctaatgctatccctcccccctccccccaccccacaacaggccccagtgtgtgatgttccccttcctgtgtccatgtgttctcattgttcaattcccacctatgagtgagaacatacggtgtttggttttttgtccttgcgatagtttgctgagaatgatggtttccagcttcatctatgtccctacaaagtacatgaactcatcattttttatggctgcatagtattccatggtgtatttgtgccacactttcttaatccagtctatcattgttggacatttgggttggttccaagtctttgctattgtgaatagtgccacaataaacatacgtgtgcatgtgtctttatagcagcatgatttataatcccttgggtatatacccagtaatgggatggctgggtcaaatggtatttctagttctagatccctgaggaatcgccacactgatttccacaatggttgaactagtttacagtcccaccaacagtgtaaaagtgttcctatttctccacatcctctccagcacctgttgtttcctgactttttaatgattgccatcctaactggtgtcagatggtatctcattgtggttttgatttgcatttctctcatggccagtgatgatgagcattttttcatgtgtcctttggctgcataaatgtcttcttttgagaagtgtctgttcatatcctttgcccactttttgatggggttgtttgtttttttcttgtaaatttgttggagttcattgtagattctggatattagccctttgtcagatgagtagattgcaaaaaatttctcccattctgtaggttgcctgttcactctgatggtagtttcttttgctgtgcagaagctctttagtttaattagatcccatttgtcaattatggcttttgttgccattgcttttggtgttttagacatgaagtccttgcccatgcctatgtcctgaatggtattgcctaggttttcttctagggtttttatggttttaggtctaacatttaagtctttaatccatcttgaattgatttttgtataaggtgtaaggaagggatccagtttcagcttctacatatggctagccagttttcccagcaccatttattaaatagggaatcctttccccatttcttgtttttgtcaggtttgccaaagatcagatagttgtagatatgcagcattatttctgagggctctgttccattctattggtctatgtctgttttggtaccagtaccatgctgttttggttactgtagccttgtagtctagtttgaagtcaggtagcgtgatgcctccagctttgttcttttggcttaggattgacttggcaatgcgggctctttttttggttccatatgaactttaaagtagttttttccaattctgtgaagaaagtcgttggtagcttgatggggatggcattgaatctataaattaccttgggcagtatggccattttcacaatattgattcttcctacccatgagcatgcaatgttcttccatttgtttgtatcctcttttatttcattgagcagtggtttgtagttctccttgaagaggtccttcacgtcccttgtaagttggattcctaggtattttattctctttgaagcaattgtgaatgggatttcactcatgatttggctctctgtttgtctgttattggtgtataagaatgcttgtgatttttgcaaagatactcctcgagaagagcaactccaagacacataattgtcagattcaccaaagttgaaatgaaggaaaaaatgttaagggcagccatagagaaaggtcgggttacccacaaagggaagcccatcagactaacagctgatctgtcggcagaaactctgcaagccagaacagagtgggggccaatattcaacattcttaaagaaaagaatttttaacccagaatttcatatccagccaaactaagcttcataagtgaaggagaaaaaaaatactttacagacaagcaaatgctgagagattttgtcaccaccacacctgccctaaaagagctcctgaaggaagcattcaacatggaaaggaacaaccagtaccagccactgcaaaaccatgccaaattgtaaagaccatcgaggctaggaagaaactgcatcaactaacgagcaaaataaccagctaacatcataatgacaggatcacattcacacatagcaatattaagcttaaatgtaaatgggctaaatgctccagttaaaagacacagactggcaaattggataaagattcagacccatcagtgtcctgtattcaggaaacccatctcacgtgcagagacacacataggctcaaaataaagggatggaggaagatctaccaagcaaatggaaaactaaaaaagtcaggggttgcaatcctagtctctgataaaacagactttaaaccaggccgggcgcggtggctcacgcctgtaatcccagcactttgggaggccgaggcgggtggatcatgaggtcaggagatcgagaccatcctggctaacaaggtgaaaccccgtctctactaaaaagacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccagcctgggcgacagagcaagactccgtctcaaaaaataaaaaaaataaaaaataaaaaaaataaaccaacaaagatcaaaagagacaaagaaggccattacagaatggtaaatggatcaattcaacaagaagagctaactatcctacatatatatgcacccaatacaggagcacccagattaataaagcaagtccttagagacctacaaagagacttagactcccacacaataataatgggagactttaacaccccactgtcaacattagacagatcaacgagacagaaagttaacaaggatatccaggaattgaactcagctctgcaccaagcagacctaatagacatctacagaactctccactccaaatcaacagaatatacatcctcttcagcaccacaccacacctattccaaaattgaccacatagttggaagtaaagtactcctcagcaaatgtaaaagaatagaaattataacaaactgtctctcagaccacagtgcaatcaaactagaactcaggattaagaaactcactcaaaaccgctcaactacatggaaactgagcaacctgctcctgaatgactgctgggtacataacgaaatgaaggcagaaataaaaatgttctttgaaaccaatgagaacaaagacacaacataccagaatctctgggacacattcaaagcagtgtgtaaagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagtagaaccggaagacatagagacacaaaaaacccttcaaaaaaatcaatgaatccaggagctggtgtcttgaaaagatcaacaaaattgatagatcactagcaagactaataaagaagaaaagagagaagaatcaaatagacgcaataaattttcaattgttacacagttgaatattagttacatttagtagctaaaggcttagattggagtgtcttttttcttcagagacagttttgttaaaatggtaccagttagaccaggtgcaggggctcatgcctgtacccagcagtttgggaggctgaggcgggtggatcacaaggtcaggagttcaagaccagcctgtccaagatggtgaaaccccatttctactaaaaatacaaaaaaaaatattagccggacatggtggtaggagcctgtaatcccagctactcgagaggctgaggcagagaattgattgaacccaggatttggagattgtagtgagccaagatcacgccattgcaccccagcctgggtgacagagcgagactctgtctcagaaaaaaaaaaaaaaaaaaggtagcaattataaatgtgttattggcttgcagtcattttttctatggagatatacatatgtgtattcatgtgtttgcatatataatgtattgagatcttactacaaacacatatcatattttacacatttaacattatatcatgaatgtttcttgtattacacacaaaaaactcataacaagtatttaatattcaataggtacttaatatactatagtatagatgtgccaacatgtatttatcaattccttattgttggatatttaggttttttattcttactatttgaaagaatatttattgttaacacatacttctacatttttccttaatatgtataacaacaaaggaattgctaaattaaaggttgagtatatttttgaagacacttgatatgcatggcaaaatgctttcaaaaaaattacatcatttcacatggcttctaatagtatacaaatgtgttcatctgtctgtagttatatgcatttgatagataaaaatggtaggttgctctaatttgcatttcttttattcctattgagaccaaacattttccatatgttcttttcctatttgtttgtctttctttttttgtctgctcacacactttgcccagaatattttagaggttttaaaatttgttttggtatttatggaagctaaaataatatagatagtaattcttagtcattacaattttaaatattttatctgatttatctttttggtctttttatgaggtttatgatgtagtacttcagatttttgataattaaatctttgctaatttatttttataaaaaatattttctccgtctacagttgaaacatatgttgctttattttgctaaatttatcagacttaaatttgtatacatgatgctgcctgtttctgagctatttatttcttctccttttacctgtttctaatctgattgaattgtggtgctttcaacatcttaattatttagaaaatacatttgtatcttatgggtaaagtcattattttctcccttcaggttattattcatttctgttaaaaggtcttagttcttttcatatgcatattcttccagttgaacattagattgagttgaaaaaatgacagcaatatttttaatggagtctccttcttatacattaattcttctgaaacttacatcttaaaatatttctcatctagaaatgtgttatttttccatttacttaagcagcttgtatctccattaaagttttgttattttccccataaggacctcacattttttgttagggttattccaggtatttttacttttgtgatggtgttcatttatttttattataatatttaaaaaatctctggtattacgtcagtgtttttaaaacatgccatttttattcaatactttaaaaatatttataaatctctgagttggcaatttctccagctctaggaagacagaaaatacacagatctgtacactcaaagaacgtgagtccagcccactcagtcatatgaacttagctggatataacacgttaacagacaggatagacatttttaccttgaacagaaagagctgtaattcaagttctgtgtcacagatacaatccgtacattatggtttctttaaataagccataaccaattttttttagtaattatttgcttccagttattcatgtgagattattaaaataagcttatgaagtaaatataagatgtttcaaatattcctatccattgagaaccccagaaattatccttattgaaatttttagaaaaaaattagataggtgcacaggaaaatccttataaaattatgtccctgacagagtttatatgtataataaaaatcaagagggtgggtgtttctaaatattcaactatatggattgaaggcattgtggtaaatccattacaaagattatactgtatatttgttgatgagaaaatatatattcttacagctataaaacaatgagcatcataaaattctatgattgcaatatatgacagtagatcatatatgtatagatgtatgtccatatatacgtgtgtgtgtgtgtgtgtgtgtatatatatatatatatatctgaacaaatatgaaggacacacaccaaaatataccaaaatattaataacaatgattatcttcacattttaggtaatttcagcttttctctttatggttgctgatatagccttaacatttataataaaaaaaaattcttttgtagttagacaaagaagaaatatgtgaagccaaaataggaaaacatgggggaaggaaggactttatatcatgtttcatctcatagcaaaactattggaagcatttcagaaacaaaagaccttaaaacttcaaactctaataagaaattgggaacaaaaatcttgagattgttatacaagagatgttaaagaccttaggcctcagtttctttcagaagcccagcaattgcaattattatttattatcactttacttttgcttgaatctctttagctaaaggtggtttacttccacttttccctaataatttatgtcttcatgataatagattttcttattatctttctgatttgtacctgtttcctatttaatgatttactctgtatggcatacatgccaaagttatcatgctagaaaaattattatgctataataattatgataccatcaaactgaattaaattatgtttcattgtaaatagtaaaatgtattaatttttttaaaagcttttttatgccagcggagataaataaagttacctttatgtactttcattaaacacaatgacagtacaagccaaactgataacaaatcaacgcactccttcttgtaacactcctaagttgttctgaaatcagctttcttaggactatgaattcaatgcaatgtattaaacagaatctgtgccttctgtgaataaaagtttcacctccatctcttgtgagtatatgtaggcagatctttgaacaatgaggttttcttccattgatttaaaatgaaaatgaacctggattttaaatgtgcattctaattgtccctttagcacatcagaacagcactgcctaatagaaatataatgtgagctacatatataattttgaattttctaaaatgcacattttaaaaaagtaaaatgaaacagttaaaactaatttagtagggcttggtgcggtggcttacacctgtgatcccagcattttgggaggctgagggtggcagaccacctgaagtcaggagtttgagaccagtctgggtgacatggcgaaaccctgtctctactaaaaatacaaaaattagccaggagtggtggtgcatgcctgtagtctctcagctactcaggaggctggggtgggagaatcacttgaacgtgagaggcggagtttgcagtgagccaagatcacaccactgcactccagtctgggcgacagagtgacttagtctcagttaaaaaaaaaaaaaaagtaatataccttatttaatacaatctatctaaaatatcattattttaacatgtaattaaaacctaaaagttaatgagataatacattattttttctaccaaatctatgtctgtattttacacttataggatatttcaatttagattttttatcagatatattcagtctgcatttagatgtcataagttttcagttgagaaagtagatccacataccaaattgtttcaaatgtatttaaaagttttccagtaactgaatcaatgatcaatttttaatttaaattcattaaaatcaaattagaaattcagctcctcagccatactacccacatttcaagtgctcaatagccatatgtggataggggctattgtattggacagcaaaggtttagaacacatgtataagatgttaacacagaggaaaagttaaaagttaaatcaatgccaaactattgggaatgttttgtctaccgggtttcaagaaataatgacatgactgatatttttcttattgaatcagctgctcggctggttggctcaactaatagagtcaaacagttgctgggttttataaacaaatcatctccttttttatttggtcctccaattttcttaaggcaaatatttgtgccaaattatgccaaagtctgtctctcctgaatatccctgttatcctcgaatattgttgagtgtcccatgaatataactgttaaatgctgttttgagttaaaaccaagaacacctatattgagaaaaaaattaaatgtagttaatgttgtaccaccatgttttgttctagcttctcaactgtctcatgtaaataagcacaataaacatctactgagtgattctgtaatagtttggatctataggtccatcatttgtgatgacacatagaagttggcccaggaaagctaaaagtatgtcatatgtcaaataatgccttccaccaagtttagagcagcatttcttccccagcattacaacttcatgtaatggcacttggcagtattggcatttctgatatgacttcttttggctagttcagaattcttaaaaaataaatagtttttcaccctgtgattgaaagggttaaatagtaccaattcattacactcacaaaaggatttattttgttctcataaatcagttttattccacatttttattattcccttgggtgagctactccaattgaaatcaatacaagtgcaagtgagacaatcaatctcgatatttgattatggattggagattcccaggtccgctttttagccagtttctttctgatcatctcccccaaagaactgaatatttttattgacatctatgagttctgaacatgtttagaaagaagataataatcttcatttgtatactgacaatggaagccccacaaatgaacaaggattaaaaaataaagacttaaaatatgtagctataacatcatcagcaaacttcaaatttctcaatatttttcttaagatgtagtcatgttttaaaataactttattctttcttttaaaaaaagacctgttaatacaactggtggctacaaaccacattcttagggtgctattaggtaaatgattatttttcatgacaaagatattatttattttcacatgcttgtttcagagctgaaccatatcaactggtctaggttaacaataagaaaacagttaaggtgaataaaatgcctttgaaggtatccagcctaggtcttttcatttctataattgtccaggctggaaagccaccatctgggggatttaaaagagaaaaacagctcaactttaaattagagagcaaaattgattaagttgttcctcaatgaggccaacatttatatatcaaactctctttgctttacaaacaaatttatatcttatgatcctttacatatcgaatgcttattttgggactcatggtaccatattattgttctcttgcctctgactctagccacctgttctaggttcttaagcaaaatttttgaaaaggcacaattaaacctttccgtaattcattatttgatacttagaataaggcaattatttgatgcacttatctaatcatattcttaaaataaatttcaaggtaatattaacactgcatttgttactttcagcaaacattttagccttatttagccatttactaattttcactagaatccattggaaggggatgtttcatgttttggacaaattacctaccactgattttttttcaggaagacatataactttgaatgttgtaaaaaagtattttagaaggagttaaaatagtaaacccatatttctttcatttaagcaacattaattactcttcagttactcttattaagcctttagaatagcagctgtataagccatataagccaggcacttggatttccactggcaaacttcctaggcatgtggaattaggggactgtctagaacttatttttgtccagcttcatttccttttcagtaatttgcatttattaatgctgaataatgaaagataatcaaaacattaatgaaggtatggtgcagtgatgtaacaaagggctatatcaacaaaatattctttccacgtgctttgttccactctttaaaaaaaatatttactcaagagaatcattctagaaactggaaattgctccctttattcaggaaggcagtatattttttaaaagttagcttctttaattgtttaattcagaggttggcaaatcttttctataaagggatagaaagtaaacactttagactttgcaggcaatatagtctctgccataattactcaattctgcagttatatcatgaaaattcctagaaagataattacttttgttctaataagcctttatttacaaaaataggcagctggccaaatttggcttgtagattgtagtttgtgggaccctgttttattataactcgtttatacattaaaatgcaatttacatactttccttggatatttcaatcttctcatgattcatttgattttgcaaaaattatgaatgctaatttaaaaatctatgtaatacagaaaaacaacatccactaaaatcccactacccataaataaccaatgttaacaaacagtaaacattattttagagctgtctcaattcatgggtgattcttggtagcaaacaacagaaacaaatttggttaattcaggcagagatgaattatattaaaggaattcaacagttcaaaaagttgtcaggaaagctggagagtcagacttgtggagaaccacaaataacatagcccagaccagcttatgccttcttaggacacccccactggcaccatcaccattcagtcgccttggaaaattatcactctacttctggattctcaacaattttagaggcatcttgaataatccttagttgactgtgagccattgtttcactggatcaagctttgtagtccccagatgaaagcaatgcaactgactggcagtcccatggtcttaccacatgaacttcaggtgtcctttcatttacaaaaaaagagaaaattaagttatgtttctaatcatttctttctacatacctattatcttctccctgattgttagagtttcttgatctttttacttatgcattaattatgattctctcaaggcttttcatcataccattgatttagattttagctctattctgttcctggctttttctaacttgtttattaaatacttactgcattttttaatttccagattgtttctctgtctctgcaatatcattttatcatattatagggaatatatatcattttttcccaaactacatggttattttgtctttttatgttacaatcctttctttagctgtatgtataatactcgatatattatttttttcttcaacttcatcttgcttatgccttgtatgggcagctctgtccagattttgcactggttctgagcttggtctacttcctttcctttctggtgctagtcagtcttctttcgacctaaattttgagcactaggtgttgctagagggtgcgaagatgcactgggcagaattctggggaatccagattttctgtctcctctgagatcctattatatagcttttgtggcagcacttgctgcatttattcacatgtatctcccacacctgggaacaccagctttttcccccaactcagcacagtgcttggcaggatggccagccctgatttctcttcctgtctctgcagactctactcagttcatttctctacatattggagaggattttttttggcttatactccttcctctgggaacaaagttaggagctgcgctatactaagaaggaatttaccatctctttcttcttttaggtttcaaaattcatgtcggtcatttttttccttttcctttatacatttgtacctggagaatcttcaactaaaattgttaatgttactgttttcatagtttgtttccattctgtcaggtattttggaaagacagttgtgtggtaccacttaatttagaagctgtgaaagttcacaatttgtccaaaatctctttctagcaaggtgattcatatatacagttcagagactaacagggagactgtaaggtggcatctgactttccccacctcctggtgttcatgtccttgtttactctccttcccttgggtgtcttcaaaacctgtgacttgctgctcaccagtagaacagaacaaaggtgatagcatgccacctccataagattgtaacctgtcttgctagaagactccctctttttgatacagcaagtggtcacactggggaggcccatatgggaagaaatgagggtgaacgccaggcaacacaaaactggtaactgagagcagccttgagtcaatagccagaaaaaattgagaccctcagtctcgacagcctacaacaaattgaaaactatcaacaaccacctgagcttgcgagagatccttcctcattggaaccttcagatgggatttcagtcctggccaacaccttgactgcagtcttttgagaccctgagcacaggacccagttagctgtgccagactcctgactcacagaaactatgagattctaaatgtatgttgctaagttcgtggtgataccatgacacatcgataggtaactaacacaggaacaccttactgtgtgactgtagcaaatgaaacaggtagaattcaacagcaaaacatgatatcattctcatccagacccccaagtcgttgctcttcttttacagaggaaccatctcaagtatatatcttccagtaattagaagaaaatgttaaacatgtcattaaacaaagaatggaccataggctttgtctgggatcaataatggttgtcaaattacttgtctgatcctagtagcaccacaggctcagcaggttcagcatggttagtaaggctctaccagaactttaaaaggaaacacgttttggtgataaaatagttgtattcatgtccagtgtttagtgtggaagccggagaccactttctatgagagtatatttgttcaataacttttagctgattgagataacagcatcagtttgttcagctggaaaaaagtttgcccaaatggcaaaaaaaataagtcaaagtggaaaaaaaccctgacatttcagagcatatatggttagtaaaaatagaccatacttctacaatttacaatagtcacagtacatctctgaatttactctctctctctttctgtgtgtttatatacatatatatagtgaactgtactgaattttatatatcgtagtgaactttatatataaaatgtataatatacatgcatatatacatatatctttcatttttataactatttttagagcagttttaggattacagcaatattaagcataaggtacagagatttttgtctatcctttatgcattatagttcctttctgatattcataaaatgagatacatttaggaaaatctgactgtggtacatagagagagcttgatggggaaaaataaaacatgcttcaacaaactttaaaaaataatttgcgatatttagaacagtaattgtgcctacacgttaaaaaagatctagagaacaaaacataaagattctcgatatctatagagttgtcattgctcttgtatgggcacaaccaggacaaatgtgtctgaagcatcttttggtgagttgataaaatagtgcatgtatttattccctgcactacaattgtcaggctagaggaatgaccaatttaaagaggagtcaaagaagtacagctttgactagatgacaactaattaaaatcactattacagtaattacagtaatgtaagaaatatgatgcattaatcgagcaccgtcctcagaaggtcttagtggttcataggctatttatttctctttcaaaatatcctgtggagaagacagcttcgtaggcatatgtccataaatattttatacattgtcaaaaacttaaggccaggaatagatttctttcaccatatattaattacaaaataaacaaatactcagcacctttcagattcctaccaacatgagatctatcagaaaaatggaatctggaagaaacacttgctttttggttaaaataatttaaaataatatttttagaaggaataaataaatgtaacttaaatattaatacagggtatatagagagacctgaaattcttggctcacagtaaaggctgattttgccagtttaccttgatcacaattcagtgtcttctgattttggtattggcagaatttcgtgatagtgagatggaactgaacaactctaaaattgagaccttaataccagaaaaatatagtatttctttgtacagcaagaagtgggaaaaattagttaataccttttctaccttaaggtgtaattggattcagaaaaagactaacttaaagcaggaccaggcctgacatataaaatcctcacgaggtaacaagaatcagtttggtttgttcactgtcatttctcattataatctttgtcatgagaatggattcatgttgtgccattttctgttcctgttacaatctttgtcacatgaataagatatcaggatgttaatgcctggcatacagtattgtgtgtgttatgatactgtacaggactacgctgacctttgcaatattatgtattctgattggttgttcatgtcacctctttcccacaagttaataaggctgtaaaaaggagagaactgaaatggccagccagtcaaattatagaatattgaaaaggtcagagcagtccagcacagagaaaaaaaaattatggaatatatggtgcattaaaattcttgtgacaatgattgtaacaagaataggaaaggatacccatttatgttattccaatctagagaaccccataggatggtattctcgagacagcaatcatttacgcatccctgagtcatacatgtgaaaatatccatttatgctgttttttccttaaaaataattgcatagattttctactattcaacaaaaaagagcattgaaaataagattttcatctcagaaaaggggcattaatattgttaacatttcagttaagactttatatttgagactaaagaaaaggtttttttataagtaaaacctgttgttcatatgagatttatttggtctattttttcatgtaacacttttctttgaaataaaataggagagtaggactgaatgaattaacctttttcaagaccctttagaatgtgggatagaccgaaagagcagttaggagtttatgtagaaattctacatgatctatgcaaaacttattttatctttatgatgtgtgatgttggccaatacacaaaaaatcttttcttcctctgcatcttcagtggaaagatagtgacagagagaaagaggtataatacttaaatcagaaaccctgatgttattgttcttaagtgtgcaataattacttatttttcaaattgtttttatgcatattttaaattttcttgtagaacaacttcattggattttgtagcctataaggagacatctgttttaaaccttagctttacacttatttcactaatagagtaaacatgttatagtccaaagctagtcaaagctagtgatcccagcaccctatgctctgatgctcatccagtaggcctggcgtagaattcagatatatgaatgtttatgaggtaaccccaagtgattttgatgtaggttgtgcctggaatattggtattggcaacctcattttgcaaagagctaagtgagacccccagttaaagcccaatggctcagaccaagccacagagggtggaggagggcaactcaacttcaaatcacagtgcttgggtgggggcgaagcaggcagtggggagttgcggttccagaactcagaagcttaaaaggtcttgcaccatccacttatactcacaaatagggtcagattggagggccaaccagacaggaatggtcgcctgcgataggacacacttatcactttcacattttcaagcttgatttttgaggctgaaccaacgaggctgcattttccagcccactgaaagcccagtttatgcagtgaaaagtggcaaagcacaaccatctcaacaagaggaacctgagcacaagcattttaaaaatctacccctccccgcccatattgaggagcccaaattcctaaagttcaaaggaagaaaggaaagacagtgagagtgaaatggaggaagagctaaaatctgtggatcctgctttggttttgaatctggaaatttttgagcttcattgagggctgaaatcctgtcagttactctaggtctgtgaattgaactgtatgtttgtaggggtgagagaacattagactcactcagctgtatagttactggagatgtacaagttcttttttgagctgagcaaaatggttatgtaattgcatacttctcataattattgagtaattatatacttcttataattactgagtaatcattgttctataactagaacttaatgttacaactaattatataattaccatgtattaatgttgttatctaggaagcttagaatgaagtgctacttatatatctccccctgccatgccattttcaaagcaagcagtagtgtttgttttttgtttgttttacagttcaaaatttccttaaaaaacaaacaaacaagcaaaatgcaatggaaaaaacttcaccaatattatactcatacatatttactcattgattttgtatttgtccctggctgaaaatttgtaaaattatattctcatggcttaattttagaatttccattgttgctttacaaatttcaatcttttataagacctgcacagttacgctacttgagagtcaattgaatatctgcttgagtctataggacaagctgacctttttgaaagtttacaattgagcatgtaatgacagcagaaatacttccaaggagctcaatatcatggggacaggaggagatctccccatgctgaccatgtaattgttcttaggcaatggttaggatggtcatatttaatcttaaccaggtttcttgagtgcaagaattatgtcttatgtacttggggcatgttctcgtcagtgcctagaaaagccttctccttgcatgcagttggagctcaataatcttcagtagaagcaagctgactagttgtaaagaacctaggaaagctaaaatggcataaattggaaatgtctttttagtgcataatgaaattatcaaaggctgctttgtaggtttcataatgtcttgctaataagtattacacatatagaggagtgcattatctacttacattttaggaccttgaaatcattctttaagctatgaatatgtctttatctgcctttactgaaagtgaatagaaattatcattgtcacgttttagcccacaagcactgtttatttcctttgaagtaaactacttatttggatgtgccaattttgggtccagagtaataaattatattatgccattagggctttcttctgctcatgaaaaaaactcctgagtattttgtaacagtagatttttcagtgacttcctccatccctaaatggttataagtatctttttaaataactttttgtatgtttttacaatttgttggacctacccatatttcatgaaaatagtcaagtaataaccagatatcagaccctcttttgcattatttgatcttcattaatttcagtttgaaatataatctgatgggacaatgacacattggtaatggatgagattagtgctgctttattcattgaaaaaccttagaattttgatgaataatacattgttaggttggaaggggtagagaataggtaggtaattgctactgagaaaatgaaatacagagtacaaaattcttaatcacttgctagttctgaatggctagaatgtatcagttgtatggattacaacaaaaacaataacatcattcctagctgttgtttatgagcaactattatgtgctggatatgataaagaaataatctcacttaattttcacaatagcactgcaatgtaaatactgtattatcattcccagttcacagatgaagaaccagacattcagaaatattaagtaaattagcaaagagcacattgctaaagaatacaagaacaagttcaaatgcaggacttttgacaaccaaatttatgttctttcctttgcactatactttgctactaaactgtgttaaaatataatgtttttgtaaatattgtaaaccttgcattttgtatactatacgatgcaagatcacttttagtatgatgccatcttttactttttaagcatttgttcaataaagattatatcagtatctggagatcttgccagtatgcttgttcttctctttgaagctcaatatcatgtgttttttaattcatttgtctatatctgcagaatttgtgtgtgaaagattgaatgtacatataataaaaagtggttttatataggaaaaaggttatttgaagtaaatattggtgctcttttagataaaaaaatctcactctgtgacccaagctggagtgcagtgacacaattatagttcactgtaatctcaaatttgtgggttcaagtgattctcccacctcagcctcctgagtagctagaactacaggctcataccaccatgaccagataatttttaattttaattttttgtttttagagatgaggacttgctatgttgcctagcctgggtggtactcttaatcattcatttttctgttttttaagagttattgtatcatttctaaaagtgacaaacattaagcagcatttaaaaaattgtctcataaatttttcaggaaagcatctaatatagaaaatgttacaattttcatctgtagcccttttcttattttaaccctaattttttactcttaacctgaaatttaacctaatggtgtaagagagagagataaaacactgttactaggcagaagtattttcctgcattttggactgatgagatttaagaatgggtttgctaaagctttggaaggacagtggtgttgggaccagggtgaggatgtattaaaagtgattcttttatatagctaggcagcttctgcattttctcataaagctaaaaatattagatcttctgatcaaagtggacatatagtacctcccatccccagttgcttttcaagatattctgactaattgaaatttaaaagggcattagatagaaagaaatccacccacatttcaagcaaagtgaacagaaaacacctcagtttgtgaaatatacaatatctgacaaatatgtctgagtataatacgtatatccagaacaattctatttgaggaataatgtgttatttcttcctgtctgcacatccaaaaaaattcagggatttttattggaaaaaaaaccctcaaaaaagtataaacaactcatcaagtaatcaatttctacatttgtgcaatacttttacttatatgcttgatacttgtgatatggctttatcctacagttatctaagaatattcatcaaattatttcgattgccgtgatgaatgaattggccaggtcaactcagatagcacttttgttcacaagataataaaatccaaatatgtgcattgatagaagcacatgtaatgcctcttagagtggtaaagttacagacctatttggtacagtatatttagaaactcaagaaaatactcaaataatagcaggaatgaattcttaaatatgtatttattttaataattttcttttttaatcagtaggtaataactacacccttctgaatgtcacaaaagtcatgtacagcggagaagagacaaacctttgggtgctcatcgatgggctggttccttttaccaactatactgtacaagtgaatatttcaaatagccaaggcagcttgataactgatcctataacaattgcaatgcctccaggaggtaagtctatgcaaatgttggctatctaattttatataaatgccctagaattaagtttccattgaataccttgtttatttttagaggtattttattttagaacttagaggctcaattgtatttctggttcttttaatagttgttgttttgctttgtttattcagattctttaattgacgatcttttattgttttgttgagactgctttcatccacctcacactgtgtgtatgtgtgtgtatataccatacacacatacacacacacacatatatatatctggatttctgcatgttaagaaaattgggaaatgattttgttcaaggcgttacttaaagccaaaatttatatttgcaatttgagcttccattttctactgcaaatggttctcattcctggtgttctaaataactagttcaattgtatacttaaagtacttcatttggcaaaaagggcagggtgcagatgatagaataggaaaattccatttgcactactggaaaacacctttaaattcctgatcctaataattacagttcagcagggccacattcatgtgtgaaatgtgatacagtctgcatatttttattttaaatatttctataaaaatcgacctattcacaattaccattattttgatgtgccttcagcttcaccatgttttaactcgttgcgggaaataatcgcattgaggaaaacccctctagggttgacatggatggcccttgaacagaaagcatgcctcaaaatgttaagagcatgactctcaattgagtgctaaagaatgtgtgttttctgaaaatcctgaaggcaaaggaccccaggacatccagcatctgccctgtagcccatctcccaggaatgagtatattctgaactaagggagaatgtcacaatcttttatcagcaatccgaagggcaggttaaccccacttccagttatgaagagtataagaacacaaagtgctttatcactggagaaaaataaaagggaatcttcagtttgtatggaaccgctcccctgcaaaaaagattcattacttgttgtatcataaaaccacacactattatctaccttttatgccattattaaaattaatgaattgatgtttactaaaatacttgaaactgtaaatgtcagaagctacattacttaagaaaagaatgcataaaagaaacttttgaggctgatcaactcaggttagtatcatatttattgagacaataattttaaaagggaattgaatttagatatatttatttaaaaattgagactgaaacccaaaataaaacaaactccccccgctaaaataaaccttaggtattcatatcttcatttttcacttcaatacacatgctaggaaggatagaaaactgtgatggctctaaaccttagaatataatatcctttactcaaatttagaaattaaagagtaatcagtgccataatggaggttttaagttatatagtaataccttttctacaggatatatacaatatttaataagcgtgtttattttagggtatttatactgattaaatagtttgtgatttacagtaatttatatcatattcataaaatagggcaaatttaattcattgtttatgtttttaggaatgtatggtctaataatttgttatttatacatatatcaagattcaattaaaaatagcaaggtcctactgctaacggaatatgcgctatgtgaatatacctgtcagtaaaagggttaatattatacaaatagaaagaaactaaaatattgttttatagtggtgcagtcaaactgagtaaaccattaactgaggcttatcttcatctttgctctgtggatgcttatctgtgtcattaccataatgcactgcaggcccacactctctgggcctgatgcaatcctccactttatgtattcagaaatctagaatttgggagtcagtccttcaccaaagaggaagcaaatgtcttcaaagacagacagtgattcgctaaagtttattatggccattaggacatactttcttttttcattagattgttgttgattacaattaggaaacgtatagctttaaaattatcttttttatgaccttgtggcagtttaaaggtgatacctcattgattaaataggttttagttcatgcttccttttacttaatgatctgaaaacatattatcctgatttacacataaaaatcatgctgaaaagcatgtggcattcactagaatatgtgtgtttaagtagaattaaattagtactgagagttattaaagaaatcttccatgcctttgtccagtgaactgtgtttcattctgaaatgaataataaatggaccaatatacggaggcaaaccaacttatgggcagagaaggttctatatgctatttacttttccattatagttggattgttatcattattgccatttccttgatttcaatattagatctctcttatggtgatgttgaattcctagtatctttcaatgctgggtgatgcaagatttgtgatgataatatccttagctatgcttcttttgcatacttttaaaacataataagaaaagagttgggcaaaataaaatgctcttttttacttcatcaaatatttgctatcaaatatgacctggaaaatcccctttacccgtttaatctggccaaatcctactcattttttagcctcaaacctagaaattggtctatcagaaagtcatgttttgccaacagaggctgagatagggcctttctgtatcccagagaacagttacattatactgaaattgcctgtttaatctgtcacaatcactggttataagatcctatagagtaggaactgtttcttactcacatttctatcttcagcacctagactaaacctgacacatggtaggtgcataatgaataattggtgaatgaataaattagtcaagattgcttaacgacttgttttaaattttaagcttattattactcaggccctccaggcctcatctcaacctcagcaaccttgtattttagccagctgtgaaagagaccttctctgtacaccactgtccaatgtaggaatgctctggttatgtagataaaattgggagctcaaactgtaaggagggtgagtgtattggaggtgagaaatattctcaagttatgccaactcttcattcttttattcttccctatagtggttacttttctcaggtgagcatagaataaacaatccttagtttagatagtaatttggaaaggagaggtgaaagggtcatactccaaagaattttaccaggatacatcatctcttaatttgtagtcaggacacatcttatttgccagtcctacctctatttttctgatgagaaaaaatatataattaagaatatgataaacacaagttatttgaagatagaaattaaagtaagaagatggtgctactaataacttggcacatagatgaacagtggcaaatcccaattaacacacattttttatttgaaaaattcactttaaatattatttggacaactggaggggcgtctctgttttttccaattatgtagcagatccttccctacttctgcacactcaagttttttgtatttctacaattactatatttttaggttgtttgtaataacataatgctcatatttagcactaaggtattcttggaaataaaggatatatttaatcagagctcttgaatagtattatggtacaggttcaagagttctaggaaaagaattaaaaaaataaaaacgaatccaaatgttaatccataaatatgaaactttcctatggcctttaccccttcaaggtctggagttactaatggggttaggatttcaacgcttaatggggctcagtgcattagtgttttgtatgcatggaattcagcattcagtttaataagtggttgacattggtgatgtcccttaatttgcttaaatctaattggctcttttatcagtcaaacctgtatggattggcaattgatcagaaagggtcagccatgactctgcatgtagttaaatgatggaagcaccagttaaagtcacagttgcatgataataagcaaaagaagaacaaatgagcttagaggaggaaggcaaagaagcttagaagttttgcaggatcttcaagttcagaacaaaggcattatagagtatataaattttaaatacactgcattttgcctccagacttaaacctttttttttccagatgaactgaaatcttgtctgaaactgtctttgttacatcaaagaactactcagaaagctaaaagagacagaagaagcataaaagggcatagtttaaaatgattagtgacaaattccatactgacgagctagaaacagatttttaatgaaagttttatattattccaaaaggaataattctgtttatctttttctgaactgctttattgtaacagtgaaaggaacttggagccaccctggtttgtgaacctaatccaattttcctctgagagtaaataatttgtcatttgtacttttaagttgatgagaattattataatctacaaacagtgtaaaatactaggcttgagaaaatctgtttatttgcccaaatgtgttattagagaaccaaaaattgaaaaaggcaaaatggttgcgagtagtttgttttacagggtcttttcgactctctctccttcccctgaaccccctctccacttatccacctaaaatatcaatgagaaaaaaaagaaagaaagaaaaccattaggaagtaaaacttaggcacatcgcaaaagcatagacgttggagtcctagaaacaaggatttaaatccacctctttcactcactgcttgagtgactatgagcaaatctgcagatataactgagcttcagtttgctcatccattaaagaggctggatggtaattcccacctgactggaggattgaacaacatattatatgtaatgtgtttagcgcattgcctgtcttggtaaacatttggtgcttcctacctcttttgttctattttcctactaagactctttttggggacctggaaaatgccctatagaaaaagtaagtaaaaaaacctgtctttcacatagactgcagagaccagaataatttcatcttgctacatccctatcctttcctacacttaccccttaacatgttgacatacatatggccaggccagtaaccctgctaaggggtggttgtgatgcatattagatgatgaagtaagcaggaagcatgggaagtgattttctttttgaaataccttcagcatcctcctccatgacctccagatcataatttgcgaagatttttacatcaagctctcattggtcatcttgggatttcacatattttcttaatagaactcttcttctgtgtttatatagagctacttattaaatataattatgactttttaaaaaatgtctattattgtatattttattcacaaatgcttttttttacattgttaatgctagcccaaagcaagtaatttgaaattttatcctaagatgttttcatgttttcttaattgtcctcaaatacatatatttaaaagttacatcttggaattcaaactttttttcatttttcactaaataggaaagtttactagttgttcagccaatatgcttttgaataactaaataaaatgtttgcttttaaaagatgttagtatatgatttttgcccaataataccactaaaggaataatatattaatgactaacttttttagcttgaactactgaattccattctgtttagaatttaagagactggaatattctttcgggtattgctgtgtaacgagtcactccaaaagtcagcaacttaaaacaaccattctgtattatttctcacctgattgtgtgagttgtcagcatggttctcctggcttaaggaggctggactgggcttcttcagaattcccagaaagaaactcagggtttcaagagtcaagccctagtgtacaagccctgaaaacctttgcttgcctcaaactgtccaaagcaaatttcttgcccaagtcaaaaagcatgtatgctggaatgtatgatttactggagcctgataatttgtcaatcttccataaatgtctaagtgattggtttttagattgtgtatgtgtatatgtacaaacacatacatgcaagtattacagatacataatttttcttttaaattagttctgcttttgaaataatgatgtactagcaccaaaaaaaatgaagaaagcagtttactaaatttttccttgaagaagatataaaaaaaaatctttccttacatgacaattaattttgatgttttatttcagtataaagatcaataaatgtatatcaatagattcttgtttaaaatgtttgtagctccctattggagggaaaattctgatctcttcttataagtaggtgatttaaaaaaaaatcttagctatttctcaaatctaggccttgggtattctgatttctgcttgtaactttgaactgtgagagtagaaactgtgtgtaatttgaatattttctgtagctccagtgtctggcataaactatttgctgaataaattaccagagccctttgtggcagtgataacttggaaaataatcctgaaagttatattttgctattgctgtgtcttttacttggataaacattttccagaattaaattcaacatttagggtttaattcatcctaaaattatttttagtcctgttaagattaccataacagtgtaaaaatacataatataggaccctctggaggtatgtttataaatttgtgtgtgtgtttaattgtctattttacctaccattttattttttatttttaaataattccatcttttatattatgtttaggggtacatgtgcaggcttgtcacatggatatattgtatgatgctaaggtttcaggtatgattgatcctattgcccaggtagtgagcagagcacctaatagttttcagttctttgctttctcccactgttccccttctagtagtttccactgtaaccaccattttcaattaacttatctattgtgattggtggttgaacacttaactgaaaataatgattaaaacagaacatccaaaaatttaaatatatattaaacacaactttaatttagaacacataaatatatttatctatatatttatccaacaatcttgttatatagggccaagttgttttcttggagtgttaatttagtatttataagtccagcatatttgctgccaaaactatattcataatgcatagtttgatttccactttgaaaactcctttaaaaggagaacaaaaatttagagataattaaggaagaatctaattatagaatttttcaggcttttgtaatatcctaagtcttttagttatttttcctgaacgaatttcacagtattgttttattaagtcctcactgaaagtttttcaaagcagtaaattttcatagaaaacggtttctgttaacagtgctcatcagtttaagcattatttaattaaatgacataatcataatgacaaccacaattgacatcacaggtttaaaaaatacagctgactctttgtgagtgtataattctacctgcgactgcagaatgttgcccttgaactacagagtagtcaactatccatctctgcaatacagagtaaatgtaaattttttattaatctggcaagtcagataagaataggtaggtaaggctgggcgcggtggctcacgcctgtaatcccagcacttcggaaggccaaggagggtggatcacctgaggttgggagttcgagaccagcctgaccaacatagagaaaccccatcgctaccaaaaatacaaaaacttagccgggcatgttgtaattccagctattcgggaggctggggtaggagaatcgcttgaacccgaaaggcggaggttacagagagccaagattgtaccattgcactccagcctgggcaacaagagcaaaactctgtctcaaaaaaaaaaaaaaaaaaaagataggtaggtaaagcaagtgtctactatttaggaaaaagacacgcttccaaagtggcagaatgatccaccctcagagcagcctacccaagtaggagaggcaggacaatgctaccaaattcttctcttaggttaagcattaccacagctctgccttaaaagaaaaaagaaattattgattatatcccttcaattgattagggactgagtctgagatttgtggcataacttgctcagtgaacttatttttctccttcagtttttaaaggaaagaactgagctttctcttctattttcaaatttcaaccaaaatctctttctaagaccttagagcaatgaaatgtgtgggtagcactatcaaccagccaggtggagaatggtatttttttttttttttttttttttgcagggtctctaagagaattaggggcaactagaactggctcaaaaagcaagaatatacgaaagagcaaaagagtaaataaataagaattgcaaaaacaaactctattgtatcttgcactttcttcatgcattgtagcactgagaattgtaaaatatttctataccttttgtttgtttttgttcttgtttttttgagacggagtctcgctctgtcacccaggctggagtgcagtggcgcaatctcagctcactctatgccttttaaaatcaacttagtacaatgtcaagatgctactttttaaaaataaaactaatggttctcaaaaatgtgaaagcttgcttgccgagtacagatataaagctcctcaatatgtgttttccatttttcatctgctctgtatccacttagatttatttgaaatatataaatagaaacattaatgtgcaggtggcaatgggatatcttaaaaattgaaagagtacaaagggatggagattttaaaaataaacgtaggttagcagctgaaataagcaataggctaagatggtatattcccttattcagagggtagaaggaaagatgagattaactgctttttataatgtaaaagccacaatgaagatacaggatggtgaggaatagcattctttaaaacgacaacattctaccacataaacagatggtttgtctttaccttcagtatattaaaagctacacaatttatattacatccagttcatatgaatctttcgaatagttgtgcataatgttttacttctgtgtatatcttccaaatgtgctgctattttttccctggaaaaatcaacccattgaaagtaataaagtaggagaattcaacaaataaaaagtatttaaattcttaataaaataaatagtgtgctttcaaaaacacataccaggccatttaatttaacccatgctttctcccaggtacgagaatagaaccaaaggatttatgactgtcttaaacatgctctcaaatcctttcctgaaaagtgttacctttacttttttggaattgatagtttaacctgctttgtgtgtgtgtgtgcatgtatgaagaggtatatgtttgtaatattacatatcataagccaaagagagggataaattcctgtttcataatttgtgaacaattttttcactttttgtattcaccatcttgacaatgaacttcctgcttataaaaacaccttagaaaaagactaacttctgagctatggagaagagggaaggaaactttgaagtgtgcttactatggactcaacaagcctccagcaaagggctgccagctctccatatttgcatactctcatgtggattatatagaaatacacacgcccacacacacaattaagtgctatctttaaagcatcctggggcaagagagagagacttaaaaaaataaaataaaatcacatctttttcttttttaccaggggagaggggtgggaaatattgttcctttaagttccattgatattttctaactcacatttttaaaaagaataagtacaattcattttctttttttttcttcgaagacggctttatccataactttaagcttaaaaaaaaaaatcatgtctgtctgactgacactgcagtctaaaagcaacttgaagttttatttgaatttttatagtgccctaaagaaatttttgctttatttctttaaaataatatcttgttcctcattttttcatagacaaactgtatgcctgacttgcataaaattctatgaacatttacctgcctatataaatactcacaaaagtgagaaaattcttaatatgtcttagatacttagagaccatatttccaacctcttttcatcagcagcatcaagaaaatccctttttctatctctataaaggcatatagaccccccagagtctaaaagaaaacttaaaaacttaaggaagaatagattttgacaacagtagggaaattcacttacaaccactatgcttttcatgattgttaattaattgggacaaatgaaactagaaacatgagggtatctaatatatactttattagattaatccctcttacactttgatgaccattttcaaatgtatactatctttcatttttatttaaatgtttcgtatgcttgtatcatgtcttatctactagatggggaagataaaacgaatgggctgggtgtggtgtctcacacttgtaatcccagcactttgggaggctgaagtgggaggattgttgagctcaggagtttgagaccagtctgggcaacatagtgagaccccatctctatttaaattttaaaaagaagaagtaaaatgaaaaaaaaaatgagtgggtgaatggaggtagacagaggagtcacagctggtctccctttttctttctctatccctctcaccatttaccttggctcaggcatataataggatattagtaatgattactatcatgctcttgtgcagtcctagtggcctggggctatttttgcacccagcataccttcaccctttcttttgatgacagggctccaatttccctctcagcaccctgggctctttcaagatcagaacatgcacatgcgctgtgtgtgaagttgactgcatcaccaggtctgaccaatgaggacactgtattctcctaaccacagtgattttttttcaggaatgacaggcattccaatcaaagccactgaattgcagtaaaccagtacagtaaacagaggcatgtctcttgccctgtatttgaatatgggattcggctcaatttgctgccagccatgttgcccctcaaagagtctgagaaatttagtcagcaaggaagaaagcagagtgggtatgagagaaggaggtagactagattctggtgacgtcatttgatcctttgaatccagcattgccaaaacccagctctttcccttgagtgtttttttgtttgtttgtttgtttgttgattacaggaacccactacccatctcattgcttaagcctctatgtgttgtgttttctgccacttgaaaacaaaagcatttgccacaatgcttgagagaaaggaaaacaagtagagagcatttagagaagtctcatcacttcctgaaaatcatgccaaatgctaaacttaacatatgtgtttggcttttgcttgggctctcaaattaggaaacctcaagaagtaagctggatgtcacatgagataatattttctaaaactgtgaaatggctcatcccattctgaagggtctcctcagagccacttcatttgacaatcttctgagctgtttctccactattttcaggtctcagagccctgagttctagtaataactcttgtgctaattagctgtttggtctgacttaagtaactttacctgactatgatgttggtctcttatctctaaaatggcagatgtgaattagatcagcagtatctatagtgtgatcccagaccaggaacttcaacattccttgaaatttgcttgaaatgcaacttctcaaaccctactctcaacctacttaaccagaaattctgagggtggggccaagcaatctgtgttttaatgagattccattaccaactcccaggtcactgggtgccttcacaagtttgaagaccactgagctagaccatctttaaaatactttcaaagaaaaaatatatgatcttgtctatgactttattccatattcatatttgagacaaatactcagggaaaaataggtataataggcctccatgctcaactggtctttgaatatataagtcacattcgtagggccagaggtctttccaatgtaagaaagccatcgtgttgctcacagtcttcctgaatgggccaggaacagataccaaagataaccaattccagatgttgagttctacctgtggcaccagaaagcaacaggcatgatgttttatgcactggggaacactaatcagccctactgtgaagacactgtcagctaaatttcctttgctcttcaacttcttcacagaacatctgctataagaaactccttgtaactaaaacctgagtctttcccctctggggaattttctttaatgagcctcttgtggctacatctgtacagttttgaaatatgtttcctcaagtcagttacatcttcatcctggattctagggtttgctgtctattggacctcatagctaagatttttccttctaggagttcacaaacacaactccagagtaggttgacatagtgcccagtatctagagaaaaattaagatcatgtaaccttttatttgctaaaaagagatttttgatgttgtgatcactcataccaagatagcatttattaatactaggtgcaggtgtggttttgcatatattaactcattttattctcctcacaaaccctgtaaggcaagtgctattattatccctatttacacataaggaagttgaagaaacaatattggcttgcaactagtaaaggtcatcttactagtaaaaggcagacactgtatttaaacctagagactgactatagaagcctagttctgagccactatactctattgttctactgactgtagaactatactctatttcttctactgactgttcatatgctctcttggcagcagcaacacagattttgatgccccactaatcaatgcagatctgaagaggtgacttgactctatagtagggtcaaatataattttaagggtattgttggttgaactagtaggtttttaaatcctgttgcagatggcctagagaactgtcctcagtgactgtataacccatgctctaaagtttataatgtcataagagaaaaaaaatgtaggtaaaacatgtttacagccttacaaaaaagcattaagcagaagcaatattatgtggtacgtaccctgtgtggagaaggcaaagaaaccaaccagttggactcatcctttgccagtgtggatataagtacttaacttgcccaccaagtattttgcccaacttctgtcatatttacctatgaacttctattataaattattataaattgtgatcttctgattgtacatagtttgcattcttgtgaagagacttaatttatctaatagtgttaattttgaaaaattaacaaactttcttaaaagagagcaagaaaacttatatttgtaaaaactaatgaaagaaagaatctttttcttcctgtactaaaacaattttctgtgaacagttgaaaaaacactctagtcaggtgaagacacttattcatatgtggaatattctagaaataagccatgtgaacagtatgagtatgtgggaaaattgttcactggaatggccacaaaatgaccatgcgtgacctctgggccataagaaagcaggaatactttcctcatcaaaatctgaagttgagggcatgatcacaggaaaaagcttaaatcttattcccatggttgatgctataaatcaagtaagcgtgtatcttagactgtgcatttgtaaagcacagtgtctatcaaaatatcacaattcaacttatccaccacttgctatccccagcattttcatttcctgattgtgtgaccttgagaaacttttctcctctctaagcctcattttgctcatctgggaaggggtttcataattacagaactttcctcaatgggtttagacaaggaataaagaatgtgtgtgcactgagattagctggcacattaggtagctgctcaattctttgtttaaaggacataaagcatgatatataaatacaaaatatatgtaagcttatcactattcagttgaaaattaacctgtaaacatctacatttttatcttctttgatgattccaacagctgtctctaaaactaagtgtaaggaaacagcagactggttgtggcatattaaattataagtgaggactaatttgaggatcaaagatgctctttgggagatatcgcctgactagtaggaaaagcattagctgtctccctctgtctcatgtatttgttctctctgtcttggaaatatccttccccacagtttctgaatcttgatgtttaattgaacacaaaggtctttgagaaacacaacagggggttgttcctggtagttctagcattgaggaaattgaaatgtacattttttttctcatttatcaaagaagggcaagaatctaaactgacattttatatcaaatgaattatgaactgtgtactttgtacctaagggaacaacaactaaattagagttttagttaagagagagagagagacaaaaataggctttgaataaaacatacagtaatttctgctactgtgcctgacagtgacatggccagatacagttctattgtagaactagtgactggatgcaggctactctgaaatctttaaatgtatttgagagaccgtctcagaaaaaattaaacctaaatttcttatgttgttagactttatggtcagtgaaatagtcttgataatctaaagttaactttcagctttttatcaatgcttactttcttaaaaaaaataatagttgcaaagttttacttcttgagaaagtatgaaattataggttgcttgagagggaaaatacaatgcagaataaaaataatatatatgaaaatgccacattccatctctcctctgattatctgtaacacctacacaaatactacacactacactcatatgttattgtgctcataaagagtgtgaatcctaagatcagtgggacttggttcaaatcttaatttcccccctcctactagctgtaagagcttcggcaagttatacaatcagagtctgctttactttgttcttctgtaaatggtagtaaataataagcactatctcacaggattgacactgagaacttaattatgatgatgcctgcaatagatacaacgtgatgcagtacacatagtagttgttacgttgcacagttgtttccttccctatgtgagaagattaggcagcagcaaattagaactccattatttaatggctgctgattcctgaagtataggaagtattagaattaaaattttaaggagaaggaccctataatgtctgtgcaatatatctaataatcattttttaaataaccaattgaaaattcttgggaattgggggtgattcatgctttcttcttctggacaaagctatgtattgattaccatatttttcttcacaaataagtattccaatttatgcaatataaaaataaaagaagcgttattaatatgaatacatttgttttagacttctaaatccccctaggttcataaacctaaaagtgacaaaattccttgatattaatcccatatgctttctgatgccaatgctatactggataataattttgtgactaaattactagaaacaaataactatcactgatagcctgattacaaattttcttcatataattattgatcattgctgtggtaaaatgaatatcataatttttattctcaaatgttgattctaactctactacttataaggtgaaatcagttcttagaagtctttcagcagtttaaattctgccaatgactattgttttattcttactaatagataatgtgaaattaatggcatgttgaggtaagggatgctgtcttgtccgtttaggcggctacaacaaaatactatagactaggtgccttacaagcaacagaaaagtatttcacacagttctggaggctgggaagtccaggatcaaggtgctgacagattcagtgtctagtgaaggctcttcttcatagacagtcattttctttactctaacttcacatggcagaaggggtgagaagtctcccttgggtctctattacaagggcactaaccgcattcatgagggctacaatatcataacctgatcacctcccaaggctccatctcctaatattatctccttggcggtgagaatttcaacgtaagaattataggagggacatagaccatagcagacaccccacatttaagtattttaatgctagatctagttagtatttgagtaatttaattaataaacttgaatattatatccaatcccgttgttacaatgacttttataaccaatctgctctgattcttcaatcattaaatgactaaatttttctccactattcaaagatcacttaatttcttggtatttgattgtatcttagaatagtggattcaatggcaccatagaggaagagtccaactctaaaatataatggtttattttctacacgacctcagtcattttttgttttgtttttgagaaaggctctcactttgacaccctggctagagtgtagtggcacagtcacagctcactgcagcctcaatctcctgggctcaagcaattgtcccacctcagcatcctgagtagctggcaatacaggcatgcaccaccacatccagctaattttgtattttttttttttttttttttttttttgtagtgatagggtttcactatgttactcagactcgtctcaaactcccgggctcaagcaatctgcccatctcagcctcccaaaatactgggattataggtgtgagccactgtacccagcccctcagtaatttattttgctatttttcttgttggatacattcaacaagggataatttaatgcagtcttcctgaaaagagtggctttgacttgagcttgaatttatttattgttaaccttgctaagcatatcaatttttaatttcacaaagactaaattcttcagtgaattattttaaatgaagtcaatgagcaatattagaatcaaaaataaaatagaattaattgaacagtattgttgtatatattttaaattatttttccaattgaagatatgctttaaacaaagggctcaagcaatcaggtactcaaggaaaaagaatttaatctatgctgcctagaaactaattggatgaatatgatcgtattcaaaataataggaatgctaagaaatgctcttaggaatactaagacgaattcaaatgtcgaaagcaaaggcttaactagagtgtctaaatgtaggaagtctctgtaaggaaaaggaaaaaaatttggttggtggtttgagacataacaaaaaaaaattcttctgggcattatgaccaccaacttcagggcctctaattagtctgacaaagtgacagttctacattctagttgaacaaataatgtatctaatgaaattcaaaatcgctatttttctctgagcacagtgagctgcatcattcacagctttggggtatttcaaaattaacagaggatgacttcagtctgtctgatgtttcttggttaacaaattcactgaaattgtcttgcagagcaattttaagcaattctttaatcttaaaccacaaagagaggtggaggtggaggtgtattaccttggtcctatggatgctaatgtgaagtggaatcttttatttctcaaaatggtcaacagcaattagtattcagtggtgtctttttattctggtgcccttgacccacctctgcccccctttctatattactcctattatatactgtaactggggatattcttgcttcttttccattctaattaaagcattcttagtgaacatgggaaccatttttcatttcatgaagaataattactggacctaggtgaaatctgcccattgggttttatataatttttgacaaatatttgcacgaattttgactgatctattcttaccatttctccgtgaaatgttggagaagttttcagttccctcagaacaataaacctaaatatgtacgtgaaagaccaagataaatgttgtaccaccttcaggttgtatttgctaatgtactttaaaatattttattttgtcactaatataagaaataatgatgactttttaacaatttttttttttatttttgcacatgtttctttcctagtcagagtttgacctaaatactcttctactacactagtgacaaccttgagaaatatcatttatttaggttggatctgtaaaacctatagctcttgttatacatcttgtttcttttttttattttattattattatactttaagtttcagggtacatgtgcacaatgtgcaggtttgttacacatgtatacatgtgccatgctggtgtgctatacccattaactcgtcatttagcattaggtagatctcctaaagctatccctcccccctccccccaccccacaacagtccccagagtgtgatgttccccttcatgtgtccatgtgttctcattgttcagttcccacctatgagtgagaatatgcggtgtttggttttttgttgttgtgatagtttattgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatatgtgtgcatgtgtctttatagcagcatgatttatagtcctttgggtatatacccagtaatgggatggctgggtcaaatagtatttctagttctagatccctgaggaatcaccacactgacttccacaatgtttgaactcttgtttctttatttttctctagagtcctttctcagagccaagggtgtcttgacaagtaaaagagaaaaaagttactaaacagagagaaagagagagtaacagactaagaaagacagagacaatttcttcaaacctctactccaaaaaatcctcctcaaaatttaaacgacacatttgtttaaaacctcaaaattcttgcattctttcaaaacactgagctgttagattctaccaacagtatccgctctccaagttagttctttaggttcctgtgtgttggatggggaagaggtagggaaaggaggctagctaccttttatgtctgtgaggaagggcaaaggtctggtttggctaattttaaacaacattgtttaaaataacaggaacttgaactttggagacagttgctagattcaaacagcagcacaaacccctcattacttgtgtggtcttgtgcaagtcatttatgttatgaagcttcagattccttgacccacctacttcacacctaggactattaggaggattcagtgtgatgatacatacaaagcatttagtccattgcctggtgtacaataactgcccagcattaactctgacattgtagtgtgcttatgtttacaaatgaatatcaagatgttagcattgttcaaggggcaattaaccaaagtcattcattaaagttgttgagttgtttaataaacaactcaattaacataaagactctttaccaaaactttgaactttgttcaaatttcattcatccaaaagcagttgctgagctctttctagccaccaggcataactctaggtcctgtgcaaaacaggcttttggagcagatggcgtgcattccctgatggaactgaaggccctggccaccattgtggtgaagttcataactgcacttactgcatgttctggctggctacttaagaattccctaaggagatattggatagatcaaggtacttagagcttggtttcaccttctagggggagaaagggttgctcttaacaaaaactaggacaataaatttaaatgtgtttataaataatgatgtaagacaactatgtcaatgttgttaaagttggctgttacttttaagtacaaaattgcatattccttatttggtgggattactgtacatagttatttttagaaatcagaaaagttaattgatttactgtgattctctcgttttacaaaaatgcaaattgttttattatataagaagagtccattttagaccaaattcattcccataaaatgaaaacttcttggaaaaacaacaaaaaagaactttttaagaaaatgtattgattggtaactcatgacatttcttttctgttttgctttttggctcctgtgaatctcagaaaaaaaaagtctgttgctactcaggaggctgaggcagaagaatcgctcgaacctaggaggcggaggttgcagtgagcagaaattgcaccactgcactccagcctgggtgacagagcgagactctgtctcaaaaaaaaaaaaaaaaaaaaaaagtctgttgcttgacaatggctaaccttagtagaggttttgtggtacagttcactgatctttttccttcattattcagctttgttttcttgagttttatattaaatgtttttaaaaatattttggtaattatgcaggttaataaattataaaggatatctatagttttccccatctctttctggcattctaatgacatgaatgcagattccttattgatccatataagaatgagctcccagaagtgagtgtaatggaatcaagtagccagaaatacttagtaattggattgtttttcacattctgcactcaacttttatggaaaaaaaaaactcgaatcaaagtatatcaataagatgataaatccattcattccttttcagtatccagtccagtccatttaccagggagtagccaccaccatctgtgcctcaatattttcaaactaaacaacaattgtagtttctgtgcttaaaatattgatggaattagtgattccccatctccttcgtatacatttcagactctttatctgtcctacaagaccagtgtctcccacccttgctgccttgcttttaattcctcaaacagtgagatcaccatagagcttccggcccataacaggtcagcaaagtcttagtcatttaacaggtccaaacttaaataccacttccttagaaagcctttcttctttcaaccaaaattaagtcggccccctttaatgatacctcttagcacctctgttctccctcctagcactttgtgtacattttaactacatattgctttctatttgtttgatgccagtcttgctccacttgacaatattctcatgcccataatggtgtgactctggctagtttgttcttcattatgcacccatcacctggcacgatgcctggcaagggagtaaaggaggatgggtagatcagtttttcagggaatataaaaatgacagcacagttttatcacaaatgtttaatctttctgtatttccatatttatagcttggagattgcatagtaaacaggaaagaggatgaggttttgaatcaaaattctcatgtttgaatcccagcctggcacttagcacaatcacaaagaactgtaggaggaatgcaatactcacatcatctaattcatggtatggctgcaaggccaaatgagaaaaatggagatgcattcaaaaggtgagagctacatgagaattcatgaacacaaagaagggaaaaacagacacagggcctactcgagggtgaagggtgggaagatggagaggaacagaaaaaataacctttgggtactaagcttattacctgggtgatgaaataatctgtacactaaacccccatgacttcagtttacctacataacaaacctgcacatgtacccctgaacctaaaataaaagttttttaaaaagtaattgaaatgttcgtaactcaaaggataaatgcttgcggggatggataccccattctccattgtgtgactagttcactttgcatatctgtatgaaaacatctaatgtacttcatatatatatatatatatatacacgtatatatatatatatatacacatatatatatatacgtatatatatatatatatatatacacatacctactacctaccctcaaaaattcttagaaatttttttaaagaataaaattagacccctatctctcaccatgtacaaaaataaaatcaaaattggttgaaaacttaagtcgaagacttcaaactatcaagttactacaagaaaacattggggaaaatctataggacataggtctgggcaaagatttcttgagcaatatcccacaagcacaggcaaccaaggcaaacataggcaaatgggatcacataggttaaaaatcttctgtacagcaaaggatgcaatcaacgaagtgaaggaacaccccacagaatggaagaaagtatttgccaactatccctctgacaagggattaatcaccagaatatataacaactctataggaaaaaaactaataatccaatcaaaaaatcagcaaaatatttgaatagacatttctcaaaagaagacatacaaatggcagtcatatgaaaaggtgctcagcatcatcaattatcagagaaatgcaaatcaaaactataatgagatttcatctcaccccagttaaaatggcttatgtccaaaaaacaggcaataaataacaaaagctgtcaaggatgtggagaaagggaacccttgtaccctgctggtaggaatgtaaattagtacaaccactatggagaaccatttggaggtttctcaaaaaactaaaaattgagctaccatatgactcagcaatcccattgctgggcatacacccaaaagaaaggaaatcagtatgttgaagaaatatcttcattcctatgtttgtttcagcactgtttacaatagccaagatttggaagcaacctaagttgcatccatcagcagatggatggataaacaaaatgtggtacatatatacaatggagtactattcagccgtagaaaagaatgagatccagtcatttgcaagaatttggatggaactggagattattacattagatgaaataagcctggcacagaaagacaaatgtggcatgttctcatttatctgtgggatctaaaaatcaaagcaattgaactcatgggtttagagagtagaaggatggttaccagaggctgggaagagtagtggagggttggggagaggaggggatgcttaatgggttaaaaaaatagaatgaatgcataagacctactatttgatagcacaataaggtgattatagtcaataataacttaagcgtatatttttaaataacttaaaaaatgtaattagattgtttgtaactcaaaggataaattcttgaggggatggataccccattctccatgatgtgcttgtttcacattgcatgcctgtatcaaaacatctcatgtgccccaataaatatacctcctatatgccacaaattaaaaaaaaattaaaaaattaagaaaaaaattgttctcaagtgattaaaactaagatggctgggtaatttaagctctgtattgggtataagcagaacatactttttctaaaccttgtgaattttttaagtggttacaaaatattataggatcagactttgtaatttcataaatattattattacaaataatgtatccagagcgatctcaattatgaagtcatcaaggatgggtaagaaaattacagagagaagcaataaatctgaatgtacagtgcttatcttcaagtaacttaaaaggaactatgaacaaatgttcatagttttttgggatacattaaatgacttagtgatacttaagaagatactttgattgatgttactaagaaataataaatgagtaaagcatgattgtagttatggtgtgagtaatgatatgacaggatcatgtgatagacattgggggtaagataaagatcataacaatagcaaacacttatatagtacttatgatgtgtactttattatattatgtatatattatattgtgtaaccacttgatacattaacttatttaatcctcccaaccacactctatgaaatatataccatcttaatctttctttcgttgatgaagaaactggggcacatagagattttggtacttgctcagtaagtagcacaatcaggatttgaacccagataagttggctcttaaccaatacacagatctgcctcttttgtgatttaatcaaaataaactctaaataaagacattacaataaagacattaattagctgctaatcagctaattaagttaaaaatgtaaaaagtgctaattgaacataaaggagagtgacaaaagtgtgaaatgttcaggattatctaatataataaaaagcttatcaaaggtaaaaaagttttcattggaaaagattcatgaacaagcattctagaaattaagaaatggtaaatggccaataagcatgttgtaaatatttcaatcatagtcttttggttttcagtgctatctatagactgacaccttccttatgtatatgctcaggcctaaacacatgaactccagtcccccgtagtcaatggccttctaaaaatatcttaggcaatccagaaccaacaaattttttttcttcctacaccaagtgtccctcccttagaccagaagcttaggagtcaagcatccttctttcattctctacatccctacatctgttccatcaccaaatcctctatgaacaatactttccagactcacgtcaatgaggcttctgccttgggtctgcttcatttgtgcttctcccagtgatctgcaaatctcaactcagataaaacctcatcagagatgccttccctgcctatcgcatctaacatgctaactttgctccactccctccctcatcactctcaatgcccttatattagaaatgcttctttttttctcattaaatgttagtagactttatttttaagagcagctttaggttcacagcaacatcgggcagaaggtgcagagttcccatttatccttgcctccacacgtgtatacccttacccattatcatcctcttccacagagtggacctccactgacatgtttttattacccaaagtccatagtatacactaagattcgctcttggtgttgtacatcctatggctttaggctaatatataatgacatgtacttaccattatagtgtcatatgaagtagcttcactgctctgaaaagcctccgtgttccatctattcattcatacagccctcccccaacccctggcaaactctgatcactttttatcgtctctatagttttgcctttatctttttttgtctttcatctcacccctcttaataaaaaccattttaatttgttcattactatattcccaggttatggaatagtgctaggcatataatagatgacttttaaatagctgctgagttaatgaattattatatatatacacacacatacattatatcagtcatatgtaattatatacaaattatatgacatgtagatatataatatatttaatgatatacttgtattattattatatatgtatatatagatatatataggcattatataaaatactcattttgatggggatactgggaagtggaccactcatatcttagtgatggtagtataaattcaatgttctggaaaacaattagtcaactaatatctgaaatagtagagcattcatcaacgtttacccgataactctaaaaagtgtccctaaagatgcatcattctgtatccatcaatgtcagctttgttaagtgaatgttccacatctataaaaatagtacatgcaattatttgaaaagttatgctaccaaaaatactgactggcatatatagtaaagcaaataaagtttactaaataatatgtaagtattcatcttaatgtttttcttaattatgtgcacatatatttgtatagaaaaaagacaggaaagattatctataataattttaccatggctatctctgggtagtgtaattatggatcattgttttcttcatttgttttataatctttaaagtttatatcataaacatatttgtacttaggaaaatacagatagtacttttaaaagagttctgtttagttctccaagaactaaattttatcatttgtttaataagtatttcatgagcaatactaaactctcaaaatttgttaagtgctctgaagtttacaaagataaataaaaagcatatctgctctcaaatggtttatgttatcattaccttggtttatcatgggacaaagcaataattagacttaaatttaaaatttaatggggttttgggagatgaactatggtcttgaaaacaaaagggacatgtatgaaaccacaggtttctatctactattcattgagacgttgcttagccttttctaaactcagtttttatatctgtgaaataagaacattgagagaaacgaatgataaaatgaatgtactctaaagtagtatttcagatttcatttgataatacctccaagcaattaatctcacttatgttaaaaatatttttcacatttttttgtaatttatttgtaaatagaaaatatgttcgggattctaacaattgttgggataatgacagaaataattttctctgcagatctttcccccatcaactcatccatctttcccccatcaactcatccatctttccaaccattgattcatccatccattcatccagtttttataggatctttcctagacaaagcactgtgttgggcaccatggtatctctttaattacttttctcctttaacagtcctttaagactatgtatacattagaaaataattaatctggtatggtcagctatctatatgaccattttgagtcagctacatagctgatatgaatgaacttgatgaactccaatattaagcaggccaaaattaagatgctcagtgaagtttcagcagcatcacttgaagaaaggaaagtcagtgccttcctgtgttgggctgtggcccaaacacacaaggagtgtaagtttaaaaggcattctcaaactggaacacatccaaatcagttaacaaggctagaagatggttgagaaaacatactatatggaaactagttggagagaacagagatgtttaacctgaaatggggaaatttagtggaaaggaaggcaaatgcttaaaaatacctgaggttctagcccacgaatggtaccagaggcttgctctcagggattagaggtaaggttctaaggagttcagtgttgttagcatgaccaaccatatgcactttttgcccaagatagtcccagtttatgcctgctgcatgcagctcagttcactcctattaattacttagagtgccccatttcactcagaatgtctcaatgtgaacaaaaggttatatttgccctaagttttgtagaacccatacaattctttgttctacatcagaaagagctttccaatgataaagactattcaataatgtgatgggacaacttgccaagtgactattttcctgtcactggtaaggcacaagcagagacctggggtcacctgtctgggatgttctaggtaaggattccttatttggtgagaggataaagttggtgacttttaagttttctgccttctgattttaagattctgttgttttgtttttgaatattctatggtcaaatatcagttccatgacatacctacgaaaacacaatttttaaaatatactctttctctcgctaacatgaagacttctccattttacatttcattgaatttctgtggatgttgactaattctggagatgtggcaaattcatactagtagttctgtgtgtgataccttgtggaatgatgggaatccctgctatgataaagaaataagaccgggaggtactgtttaagaatatgacctggacagaaaataaatccaacatttattgaaatttgtttatttaatattgtaaatggtttgcttttatatagatttaatatatttaatagttattctatattataaatcattcactatagcaggctgtttcagggtgtaaaattaagagcgcactgcctttgaacttaaacggcccatgttagaatcctcagtgtgccagttacatcagttctgcgatttgaaatgaaatatttaacttctctctgagcctcaccttattccgtatatcctacaaagagaaaacactacaattttggagtgtaattctgaggattagaaataattatgttaaataaccttgtacacagtatgctttcaaaaagttcgctctggtgaaagactgttttgtgaacatgaaatctattttaacctacttgtcactatttaatgctgctctgtttgtgcatccttgtgttcaaggttgactgtccatttgttagcacatctgcatattcctcataattaatatctttttaaatgacatatggtttagtgactggaaatcgagtcttgccttctgttttcaatttgttcatgactcaatgactcaatatatgtgtctgaactttaattttccattctggaaagtagaatttaaaacccttgctcatatgtagctatttcggaaaatgatgaagaaatgtgtaatccaaggattttgaatatgtgccaggctattcagcgatgcagcatataggtaaaaggccgcagtttctctaatgttaacagagaagcctaaatgagaatgccaaaaatgtaatccctgaagtgaggggataatttggggtaggctagagtcagattcctagtgaattagcaagaagcaccacatctaaatggaatgagcacaggaagagttggtgggagccctagggaatgaggctgagaacatcattaacctggatgaacaactgatagtacccccagggcagtgcttctgcaagccagggatctctgaaagacaaggcccagtgcacccctggaagtgagtttctaacttccgagtcccccgtagcatttatacctcttttgtgctgagtactctttttttggtgatacagttatttgagtcaggtctaatctgttaaacataaagtagattatttgattccgccttctacctattctgccctttccctgcctctaacaagaaccttgtgcagagtggtattcagtgtcttgtattatagaattgaatttgatacaaaatattacaggcttatttgatattttaatgcagcattttatttcactattttgaaatgcacacacacaggcaaaaaacaaaacacacctcaaaagtaacatgttggtgggatgtcctgagaaagaattcagtgcatatggaaagcacagtgaattcattttctccctaaaatattcttcttcttgtccccacagacttggtagccaccaactacgtttgtaaagcctctgtttttgcctttgagagctcactcccagagttttataaatctgcagggagcaaaggtttaggacatgtgtaaataaatcattttatattttttcgtttgttttattttgttttgttttcttagagaagtttaggacatgtataagtcattgtctatttggtgttttgttttcttttgtttttcatatagatgagagtccagtggcgtatatcatttttaaagtttaataaaattatacattcaaaagattataccatctcaattattccaatctgtgatttaatttattgcttaatgttttgtatgaatttgattttctgaagcaggttaaatttgaaattttattaaaaacccacttcctttgagtttatagattgggatagctgttttatctagtcgctgtgtagaattagtatttactggacaagatgtgttgattcaggaggttgtcttggagtgtttgccccgtgagggtcatattaaacttgagagaagttctttgagcaacagagcatcttggagacaatatatcaagctgatggatacagggctcttctgttaagaaaccagcagtggaattatggctggctcccagttattgctttggtgctaaggagcctctaaggattaaatctaggataaaaggggttaaacagaggggaaaggaaggtttccagaattcagtgttactggaagcatacagaatgagtagttatatacaaataatttaagatgaccattctgtttggaaatatttcacaatttaatatattcaaagtgtaccaatttagtggagcatattgttttgttattactcagaagagaattcgtgacatcttattattattataaagcctactttggggcacttcttcctactgtcttaatagaaaggtaatgtagtttttaacacataaggggttttgtgtgcatattaaaaactaattttttcagggctaatgacttgaaattcagaatttggattttcaattacattatactccttgatgtagaaaaattagacaaaaataatcaaaagagagacatggttttatatgttatacattgtatgcattttgcactttattttttgcctgtgttttcacagtgctcttttttctatgtatgcacttattataaatcaattaaagtatatatgtcaaataaattatgattgttaaaaaccatttgtgttcatagataaaaatatcaattaaaaagcctttagcaatgaatgtccttcaaaccaaaaatgtgaaggtaagaagtggatagttggccctggacagcaatcttcttgcactttctagtcatgccacacttttactaattgagagaattatttcatatcatttcctctttcttcaagcctccatttcatccacccaatttgtcactgagcctttgcttttattttgctcactaagaaactgcgcatcatcaaaggagatctttgctattattccatcactgaatctactcactgctctacatcttcatctgtgcattcacttttgcacaatgggagaactatccctgctctgtttggcagccagtgtgcactgactctcagttgattcaaatgtgcactggctcacctctctcttcccacactaggactttgctctggcaattctttcttttacggtatcatttcccctaatctgtgttagattcttccaacaaacatgcctatatgctgcaacatcttccagtctttagaaaaccttcctttgatatcatgagcttttctagctgctgccccattttctaatcccttttagaataaattccctctaagtgttgtctaagctcactgtatctgccctttaccccctcgttgtcttcacaaccttagctcagactgctatgcccagcactgcactgcatctgctctttgcaaagttatcaaatatctgcacttggccaaatgcaaagtttcaactcccagtcttcttcctccttaaactctcagccgagttgatacagctgatacgttcttcctttttcatgtgccttctttctttactcggcttccagtctgcaccttctcagtttttctcctacctcactgaccattccttctcagtatcctttcctagagaggcctcctcctgacctcaacattttggtggattccagggcttggttctcagacctcttctatactcattctatcaacactcacttcctagtttatttcaccatctcagcctttaaagatcacatatatgctgacctacaactcctatgaaggctacaactcctatgaagacttttcctctccctctcctccttagtccgtgttagccacactgttccttaaacacaaccagaatgttttcctccttactgcctttgaatgtactgctatctctggctggattactcttcctccagacattcggatggctacctccctcatgccagtgaagtctctgttcaaatatcactgaattgcattttcttcctataatcttcccatcgaattgaagttgttacctagtaactaaaactgcccaattctttttaccttctctttccttacactgctttatttttctacaaagcacttatggccacctggtattattgtatacacagtattcatttgtttaccacctgctccctccacttgaatgtaagctacctaggggcaggagtggtgtctattttattcagtgctgttcttcttccacatgaagagtactgcttagcacagagtggagccttaataaatgtttattgaacaaatgaatgaattattaatgaactcaaacccattacagcagattgatgaaacatgtaatctaattcttctgttctcatcactggtcattcattagcctcattgttcacagacagcttcttctgaattggagagtatgtaaaattgacacactacacaaggttatgtataaaataaagttgaaaatggaccctgatatttcatttgttctcattattttgatcacttctccttcttcaccaatggcctctggtaatttgtggtcattaggaacctatattacaataatcagaatgttcccaacaaagtatattatactagcaattaaattatgctaaagaaagttcaggtcagtccaatgtaataatagtaataatagttagtgactaataattaccagggtctaaaatcaggtgctttatttatatgatctctgaacttcacaacaattctataaaggaaaaatattatacctactttagagatcagaaaatataggctcggagtcattaggtcattttcctaaaggcagagttttgctgaatttgctttcaagtttctgaatagctttggaacaaactgatatgatttggaacaagctgatatgacaggctcatttgagttataccagttggaaaaaattaattaaataaccagagtcatcttatcaactttttttagtagaataggctttagttttacacattcctgttaggccttctagaaccattcaaagagatttccctggtagattgtaccaagcaggtatgttgaagtcagaacagatttgccggagactcaactagactagaaaaagtggtatgcatgttccaacttgcaaaattgagtaagggcaggagaagggataactctgagaagggtaattgtataaaacacatagggaaaaaagtttactttttatattttcatgggtgagcattaaggctggaatacactgtattcagccattcatgtttatttatcattccagaaaaatacaattttagctaacttcccttcctccaaaaaaaaaaagaaaggaaaagaaagccattgtgttcacatgtagtggtgtgattaaggcagcaatggatgatatcggggggaagaatatgagatctggactgcttcagtgttcaattgtttggtctgttgaacaaagagttaaatgaaaaaggtactttaatatttgcttcactaaattccctccatgttttcaattagataaacagaagtacaggtgggaatgtgctgcatattcatttgtcttgctgtttgggggccggcttttaagactgaaatactaatgtaattgtgttgaaatgaacaataaggaagtacaggagttcaggaatgaaaatgttaaattaaatggaccatgtttaacattgttgttgatcctgaggaacagtttttccagtatatggagcatttcgattccatccagcatatgttctccacagttttctctgctctaattcatctgtgtttttcgacagctccagatggcgtgctgcctcccaggctttcatctgccactccaaccagtcttcaggttgtctggtctacaccagctcgtaataacgctcctggctctcccagataccaactccagatgaggtctggcgactccacccatggatttctagagtgagcattctactttgtccattctatcagctgggttatacaatatagacataacatttttgaagagtaggtcagttctcatttgcaaaaaatataggttaccttttaaaagtacaaaaaaaccccaaacaattagaggataatcatttgctttgcaaaaatatctatttttcatttatgtagcatttaaagtaggatttcttcccactgaaacttttcatgagcacatgcattacataaagcaatgaaactaacaaaatgatgtctgaactgtcgctaacaaattataatacctattctacaaatccacatggcagtcagtctcaatactactaggatttacatctcgtataaacacaagattacagactcagccaatggctacttattttaaaagagatctcatttgatggcagaaaattacaatacttaaatgtatgttgacatcctctaaaatttttttgtagtaagaaatttacttgcttttatttctttgaatgtcgaaaacttcctaattgacatttatttcccatacaggttattttccaatccttctgcatcgttaagctatgaagtgagtgatctccaaccgtacacagagtatatgtttcggttggttgcctccaatggatttggcagtgcacatagttcttggattccattcatgaccgcagaggacagtaagtggtctgaacaatacacagccaaatgtcttctacatagggagcttaaaatgtcttcaattttttccaaagcaaagaaatgagcctcccttatttacttgttgtttagtgacaataaccttttctagggcaagagagtgagcaaaggtggtcagtctctccagaaagaagaataatgtggtcttggagggttggagggttaggcctacagacaggacaaagtaattcactataaattatgatatggccccattctatccttcagggtacatcttagcgccctgcaagagaaaggttgtcatcttctgctttatgactgaatgttctctgtttcggagaaattctggcaggcagaagaaaatgaaatatggaccttacttcatgaggctgcttacatatacttgttcctggaaacaggtttcattttcctgcttctactcataccccaaagacagccttcagcatagagaagtataatctgatagcagtatattacaaaaggtggattaagatttctttattcaaccaataaagagaattttctagttgttcactaaaaagttatttttgcatatatttgctagattatatttgggaataaatacatgactataacatttggttttatacaaattacctctataaaagcatatatatgaaagtagaggggtttttaaagaaaagttagaaattaaatcaagctacacagagtgaataaggacattgtatctttgaacagttaggttttttgagttaatcttgtgaagtcttttaatcataggcttcttaggcaatgttctctgctggcccattgccatgctggctctatatccaatgagaacgttaagtgactttcaaaagcctagatattaacacaaaagtatggtatttgcaacaatatcaattgtttattaaatgtattgttttatttctataatacctttaattgcattattttagtgaagataagacatcaaattagacattatcagtacaatctatcttgtttaaagttgactttatttttacaaaaaaaagccacctttatgagcaataatgtatgttacttaattcatttcttccaattcgtaattactccctgggagaaagttagctactttgcaaggggacactcagtgtttttgttctcaagggtatcatttagtaaattatcagcacagtacgataaatggcacccaaagtccagaaagcattaattcaccaccttttaggaggaacattacatacactctggggaatctggacaccatgatcaccagatttatggactgaagacttcacactcaaaatagatttttgaagaaacatttgaaacaactgaagatagatttgtaatctccttcttatatatagcagcatgcttgatggcactaaataaagattagccaaaaataattattcaacccactgcagaggtgatggctcaatagaatgcttggaagaagggagaaagcattttttttttggcacagcattctttattctcctagagaaagggcaacactcaaacttcctcagcggtaatctccccacaattttcactgaatgagggccatgacctgccatctataggcagggaggtagcacataaataagcaaaagtccaaaatattgtaaaataccaattagcatagcatcctttgttgagcaaacttacctttggtctcctttttactataaaacaagccttatagaccacacatacacatcgttagaattttcatacccagagaccctccattgttgtggtatttagggcttgagtttaaagtgagtggtattaacccttcattttccttaagtaagaattagtaacacttgaataaatagcaggtatcaactcataaccattatttgtgtttaaatccgttccccaaaatgaatgaactcttccttcctctgctttgtgtatacactgtgaagtcacatacatagcaaagaactggaaggaggccatgtgtacctgcaggttacgttagcagtgcacctgagacatggtgacagggtactgtatattttagatgtcagtggagatggatgccatctctgaaaggatatgcaattgagttgacaaagactgagtgattggcattgggcacaagcagtttttctgtcaaggctacaaagcattgcttataaaaccacccatgttgacagctccatgccagaatcacacttcttacttgatcctgaccagcacctcctgctcaccaaagtgcaattttctttctctttctttcttctttctttgtttctttctttcccctctctctctttcactttctttctttctcactctctttctctttctctctctttctttctttctctttctttcttttcttcctttccttcattttttgagacagcgtttcactctatcgcccaggctggagtgcagtggcaccatgtcagctcactgcaacctctgtctcctgggttcaagcaattcttctgccttagcctcccaagtagctgggattacagatgcccaccaccacacccagctaatttttttaatatttttattagagatgggtttcaccatgttggccaggctggtctcgaactcctgacctcaggtgatccagccgcctcagcctcccaaagtgctgggattactggtgtgagccacctcacccaacccaaagtgcaattttcaatgtagaaatttcacatatcgtcttacagaacgaaacagagaagtcgcctcgtgcccacatttaaattccataccatcaacaggcacctttctgcatcagccacagcctcacagctttccagtgccaaaatgggtcaccaatggcaatatttttagtgtgacatttcaagacagtgattttcagcaagcctgtgacacaggtgaaaccacaaagagaaatctaggcaggcaatgagctacagccagagaagcaaatgcatgggtgcagagaagttatcatggacagggaaacaggatgtgaagaattttaatagatttttttttcaaataatttgtcatttacaccagtgtgccaccaatatccagttccatgcatttttaaaaatctagtgtgctgatgccaaataatcataatgcacatttcctatgaatattttaaatcctgttaaatgtgtgttaataaaagatgtttgttccagccaatttggtcagtgtagtgtttaactggttgcaaccagataaatacaaacaacacattattttttaaatgtgctgctggcagtccaagcacctggcatgtccacagcttgcaaaaatgtcctaagattatgttaggcttgggagcatgtgattaataaaatgaaggcacttgcctagcagctgaaaatgttgatatcttgaaaacaaagataaccatcactcctgattatatgattgttccttctctctcgtatgtttgcaattgttttctgtatagtacatgcatgtagaaattagagttggcagggagggcaagtttttcaaacctcagcttaaatgtggatgtattcttttgcctaccgaaatcctgccttgtgttaactatgaattaacctactttttcttaaaattgtggattccccagcccaaaaaagttagataatctgtttctcttaagatttcccaggaaataagattgaaatatggaatatctaatttcagtcattttaatgacaaacatatatggcatacacaagcaattagatcaactaatgaaattgaaatcattttctaaaaatcacttccctaccctcaaaaaaaaaaaccccaaacttgaattcactttagattttaacaatttagttgtcatatatttaaaaatgtttgatcgtttcccaaatttgtagtttaaaattccatatttatatttttaaccactagtctaagaggcactactgcataaaacctgtagaattcgaacagtttattctgtaggtttacttagacaacttttcatttgttcattattttgatgacacagtgatattttaagtacagttatatgctgcacaacatttcagttgatgatgaaccacatatatgacggtggacccataagatgatgatatcatatttttactgtaccttttctgtgttgagatacacacttatcattgtgtgacaaatgcctacagtattcagtacagtaacatgctgtacaggtttgtagcctaggagcaacaggctataccacacaaactagctgtgtagtgggctataccatctaggtttgtgtaagaacactctaggatgtttgtacaacaatgaaatcgcctaatggtgcatctgtcagaatgtattcctgtcattaggtgacacaagactgtaccattgccatgctatatttgctcattgcattacatcttgttattttttcacatttataattgcactgtgaacagaggagagggcaatgaaggaaattgtcttactgcctgggtcctgctttacttttcccctcagcaaccttcatccatccttcagatactcacagtaatttacaaaggaacagaggttcttctggagtaagacagaaaggcaatgtgaggtcaattgaaatctagatctaacagaacatgcttcttcctcttttgttgcctgacataattctacacattcatcaagccccagctcaagtgtcacttcctctgtgaagttttccttcttgttgctcccttagaattttggtttgtgtttactagtgaatcatcaatatccccttctgaattgtaacgtctcaagacctagggatctgtctcaactatctttctatcaccagtgtctggcgaagggtctgatatagagtaggtgccccaaaattcttactcaaagtactgattaaaagcagagtttgattgaagtaaatccacaaaaactcaatcaagcaaacatttaccgtgtacctactgtgtaccagggactaaaagagatatgaaagttgcaaggatggatatgatactgtttttcccttgagatttcctctgtctggcaaggagcacacacagtaaaaccatagttagagtgaaagagctgagttgtccatgagagcaagctcagaggaagggcatggcccctcaacatgagggccaggaaagcctacccagagaagaccaggagaggaattggaaatgatttatatttggagtgcactttaatatcaaagttcaaatttacaccatctccacttgttcagggtaaggctggaaagcaattgctgtaagagagcactgacatatgagacctgaagagggactctcaggttgtcctgtcggtcgttccagcctctgagtatgaggcgaggagggtggggacaagaggtgaatgtaagagagggacatcccaaaagtgattctcatttttttaccttggtcagaggcaggcttctggctgtccctctgattcaatattggctgctgtcttggctaggttaacgaatgttctagttagagaggcttctgccagccccaaatcatgtgctattcggaatgaaggggagggatgtgtagaaagaattctaaaacaaaaccatttttcctgtttttattctcacaacctgtaataagagtaaaatactctgagaccgtgtaacagaagaggaaggaaacatgtggtataaaatttgataaattgatcaagataattctagagtaggacttccgaatcatttaagtgcacatatgcccttaagattactgaaattttaaaactaatattgcatgacaaacatcttatgtttagggcattttagaatttaaagtttcacttgcatccttaaaatcattctacgcaacacaaggaaaatcggaatatttttaaatgagagtggaacatatttatatgagtacattttatttaatgaagaaagaggaactacaagtttcagtagtgctacacaactattttgctttctccattccaaatatttttccagttgccttaagtactaacctctgattgctgacatgtttttcctttcaaacagtaattcaggtatctattttgcatagaacagaagacccatgatcaaaaataacatttataatcttctgattttgagagcaaaatggttctgcatgttttcactacatactttgttttctgttgcatagattttctccacaaattcctgaattttcagaattaacaaattcaaatatttacaattatttttatattttatttttataatgtaagatcaaaaggaacttattcaagccaaaaatgaccaatacggaatcctttgaaaggatggattgattaatcaaaaattctatccaccttgcctcaatttcccacttaagctctcgaatctcccctgggcacttaaagcacactcctcttccaaatatagagtgcttgtaatgtctgtgtttcttacagctgaagactgcaggtgaaagtaatgaaaaatcaagttttttatgtttactttaagaaattaatgaaaaataattttatcatagctgccttattatcactacttaaattttattgagggtgtattatatgcaagacactttagcaggaaaagtatatcctctcattatccagaaatgctatctgctggccttccactatttttaaaaactattcttgttctttagctttgaaaaagttaaattgtcaatatttgaaaactctcagtggactatgtgagatcattcaaagataattgccacaggttgatatttaatggcatgagtttagttttaattctcaaatcttaaattcttagagagtcaagtatctaaaaactgctggttattaacaaaaagatggatgtttaccataatcattttctatagcattttctatagcacctgcctataaaagaacattctgcaatgctaaaacaatacatagattcatttaatcttgttgtcttcctcattttgataatgtacctgtaaacagagttgatttgctatatttggaataattcagataagttttgcccaaatataaggagtgaatgtgatgacctttaggttttttaggatgttttcctgacttcatgaattctcacatcaatgcattttattttctgcaccaaattatcgcagatgcatctactacgattcaccccacaatatgccccagctctagaggttgaaacattctttctaaacaatactctcctgatatcaggagaaatagagaaaaatagttcccgaatattggttctcctatttgcaaactatcaaataatgtccttccaattccaacagccttttagccttcagaggtttctttcattaaataatgttacttatgttatacagcccatttccttttttatcagagtcaggctgaaagttcatttttctgcaaaactgcagtgcccattcttaatttttgttttgagaaataactgttgtaccctctttattatcacaagattaataatatttctttattttattgctcctcttacatttggatcttttattatgagctgtcaaaaattcttttgggaagtagttggggtataaataataaatcgataaaagaattcatgattaaagacaagatagaatccattattctgttaacatatcagtagtgaataacaaaaggctacattgacaattagcatgcaatatattgctttatataattatacatccatatatttgccactttgatttttaattcactggtaaatttaggggatactcatttatggagttaatattaccaaaaagagtttttaaactgagcgaggctttaattagaatggtaaaatattgcttcagggcaacaatgagaatgtaacaagaaaactgactgatcagtcatgggtaactcgaatagcaaacaagtagagaagactcacaaaaccactgaaagttatatacacactcaagttgtgagtcattcaaactgggtattcatacacatgtatacaaatacaaacaagtgtgtgcgcacacaccctttccaatatacacacctgaatataaaactaaataagcagattcctctgttaacaattttattactctattttaggctggggctgaacttttgaagctgatgagcaaaatagtttcccataaaagataatttcatttgccaaaatgaaactactttccgttattaatgttgcaatgaaatggtttgaaatatgagtctgtgatctggacagaaaggatgctcctgttcccagctccaagagggagttctctaaacaattacacccacggagagcgctgtaaggttgtattttcatcaccggccagctgagctgtgtgcctgtcatactcccagtctcccctccagtgacagccgcattgacaacatgttatactccacattgattttacagttaaggagctgattgtgatatatagagattttaagaattcagctgagaggctgacttttgccttttatcattccattaaaattttataaccatctttttcatgtcatttcatccatgaattcttactttagaaagtgatagctactgctgtgagcataacttttctcatgttcagagctttttattgtattagcaaactaccccaattatagttattactcatgttttacataattgtggtggccctttcaaccatgcagttgcaggccagttgatttgtatatagaattagatgattcggcttatcattttaaagcactaaattgaaagagtgccaggagtcaggttttaacacttccctagccaaaggagctaattaagctgctttcagcttcctctccagaatcacacaagttaaaggacccttctgcaacaagagcagcgaatctactcagccagagcaggaagctaataaaatgtatgctggcttttaagggggaaacaaatcatgaaattgaaattgaacacctctcctttcccaagataagagatcatctttaagaaaaggctgtgtattgtgggggtttgaagtgcaagttcatctcattatcatggatgtttcacccataatactatcatcatatgcaggagaaataaaagccttatcccccaatcacagagaacaaactgcatcattgttgtttcttttccctgaagatgctcacagtttgatagttcacatatgaggaataattatgcaagacccagatgaaaaccctaataaaaaatattctgatttttaagtgtatattactctctttggggaagagagggtgagataaggttagacattaaagacttgaatctccaccattgattttacgaaacccaatctcaggggatttgggggtttttttagatttcaaaacaacattgatatcttacaagactcgtacttgcttttctctgggaaatagccaaatctagatgacaagcataaataagaaaggagctgtatccccattttgatataataattgctactgctactgtataccagagagcaaaagtaagaaatggcatagtggttttaagaaagctttaaaatgaaagctaacaagagactgaaacggaaagtgtgatttataccatgactgctggttttagggttttttttagggatttctcttcaaataggatacattaccaaattgtcagaaatagcttgatttcagagttagtgcactataacatcttttgcttcgaaaagtgattatgattctaccatcagtccagttggtgacaaatacgtggatcctgttgtgtgaaagtgtactcatataaccaactattattgcagtcactggccctgcaaagcagtggttgcatttaaaatttcaaccttctttgtaacactgaatcgcatacacacactcacaagatcaacgctgttttaaacaattactaaatccaagtatatcttttttaaagattttcaataaaatctaatgttcacagaaaaatctcataaatgtcaaaattgctgtgggcagaaaaggggggatacagtattttcttgatctgttttagcaatttatagatttcaggccgtggtttataagaatgctaaatgttctggaattacagctgttactgatcagtgattgagccagatttgtgttattgcaccatgttcttgcttgtacctagagagcagtaaagcctcaatataataaaaagcacctgcattttaaatgaaatttcaattgaaaaacttaacagcccttcaaattgcagaatttaacgcagcccagtaaagcttaaataacactttgcccccgcaggctgaggggtttgcattcaaggtgacttgattgtgtcgcatggtgaaattatttacaattaaggaatttctctggagggctgcagaatatttgctgttccacaacacctatgcaggcatatggtgggcctttttcagtattcatggagcctcctgaacctttatgataattgaatcagttagagtgctgagtggagcaagcataaaacctgttaacctaaaggtcagatctgtgcattgtttatttatcagtaggtgaaagagctaaatcggcagcttctgtcacagccacagtaaaaaatcgcctataatattaacagggagtagataaattgcaaaacatggattagaatgataaacagaaccaagtataatatagaatatataatgagagatgctgaaggattttactgggctgtaaaatatgcaagtttgttatgatagtgttattgattataattagttactggggctctagaaaaaaatgtaggggaagctagaactttagtaacaactaccctcttgtatgtttattaaatttatttttttaaatcctcattttttaaccaatggcttgaataaaaagacatgattttgataaagctgtcttagagaggaaaatgatcattttagtttcataatattcaacaagtatttcacacgcaaaatttatgagcaaagcaatcacagtccttgtctttatggcacttatttatttacttattggcctttaccaagtgttcattttcatatccttgtagcagagctatcactcattttagctttgaggagaggtgggacatttccaagaggtctgactttctggatttattttactttacagaacctggacctgtagttcctccgattcttctggatgtgaagtcaagaatgatgttggtcacctggcagcatcctagaaaatccaatggggttattacccattataacatttatctacatggccgtctatacttgagaactcctggaaatgtcactaattgcacagtgatgcatttacacccatacactgcctataagtttcaggtagaagcctgcacttcaaaaggatgttccctttcaccagagtcccagactgtatggacactcccaggggcaccggaagggatcccaagtccagagctgttctctgatactccaacatctgtgattatatcttggcaaccccctacccaccccaatggcttggtggagaatttcacaattgagagaagagtcaaaggaaaggaagaagttactaccctggtgactctcccgaggagtcattccatgaggtttattgacaagacttctgctcttagcccatggacaaaatatgaatatcgggtactgatgagcactcttcatggaggcacaaacagcagtgcttgggtagaagttaccacaagaccctcacgacctgctggggtgcagccacctgtggtgacagtgctggaacccgatgcagtccaggtaagatactgactattctctctcctttgcagacttaggaatgtaccctggattgactctgtgttgaacagagccatctactgactaaacaaacgcatttgttgttttaggcattcactggagaaactgggttttggcctttggcccaaactatcttaaattcgatgtcagtttttcatttatccctgtatccccttaattatattgttgagatgcttccatttgcctcgcacacctgaaatattttgaatgccacaatgatgcttagcttaaccaccacgtcagatttaaatagatcagaaaatgagaagagatgggaaaataaggaggaatgaattagcatattaacaaaattttccattaccaatagtctggtattttttaataatcaaagaatcaaagtaatggggaaagaaataaaaatagcatattaacgggctatccagaaagtgttcaattattcacctcattctattgggaatgaactctagtggacaggataactaccattgttttggctggcatacaaacttcattcaagggaaattagtgtaaccaaacaggagggagttttgtagcttagaagcctcttttgtgtaaatacacacaggcttccatggattcagtcttgtactactgccaaaagcattggtacagtagcttgctcaccggagcacaaaacaaaggacatttgcataacagcaaagttcatctgctgaaattattacttggatctatgttgtgtgttctctctcccccaccaaaagcaaacactaggtgatgctaaacagtgtaaattgttggagaaatttaatttaacctacaaattaaaagctatttttaaaagtctttgttagttttaatatgaagctggtcaaagcaacacacatttttgatataaatatgtgtatagaattccattcattaaacactaatgggaaattaattttaagtacacgatatacgatgtttattgtatgaactgagcaatgtaaagaattgctcttgattcaaaataaaaacaaaaccaaaaacaaaacccaagcatagagttaataatcattccagaaatgactttttttttcaatcttgggggagttttgtaaaactttggtagcagtaccaatcactatgatgcaacaaaacaaacacagtctctttacaaaggcaacactacataatggacattgttctggattatttcgaataaaaatcttataactaggcgttactgattgtggccgatctgaaaaagagtaagtattttcaggccgggtgcggtggctcacgcctgtaatcccagtactttgggaggccgaggcaggcagatcatgaggtcaggagatcgagaccatcctggccaacacagtgaaaccccgtctctactaaaaatacaaaaaattagccaggcttggtggcgggcacctatagtcccagctactcgggaggctgaggcaggagaatggcgtgaacctgggaggcggagcttgcagtgagccgagattatgccactgcactccagcctgggcgacagagcgagactccatctcaaaagaaaaaaaaaataagtattttcagaggaggaactcagtgtacaattctgcttgattcagcatatataaacaataattaaaagtatcagcttgcctggctttttcttcacatttttaccctcttttgattttgtaatatcatccatgaattaaacaatatacatggcttgtcagcctgctagagaagtttagattagcgtggctagaaagctgaatctcataggcactcacctgaggccacaaggcattggtaaccccaagtcaggaatctcaatgtctctaagaaggtgtctgaaatatatgaacatggtacactagtaatattctaaaaattcacactttttattctcatcttataactaggaaataaaaagttatcaatagaatcagcaggaatattcaactgagtctagtatttaatgctatatactatttaaagagtattaagataacatatctgtccttcagtattattggctcacatgttcagaacgatcttaagactttaccgaagtggacgttctcgtgatatagcttagctggtaaacagaggtatatgacagctaaacaacgacttctctttgtaaaatatgagatttaaaagtccaaattgcaaatagaaaatattttatatgaaataacagaaggatagtcattaatgcattggttaagaaattaattcaactatttatcatagagggttgttccaggtattaggatggatgaaggaaattgacagtaatattaacagcagtaacaataataatttcagttctattgacatttacggaacatcagtacatgagtgaacatctttgtaagtgcctcttttaggcagtagggacacagaagagatcaagatgaagtccctaggctcatggcgattacattttagacagaatgcaaacaaataactatgtaatatacctggaagtaataaggacttgggggagaagaacaaattgagtgtagagaaatatggaatgccagctgatagggtgggggataatacaaggagcagagttggtatttcaccttagtgttactcattttgtgcaatgtggtttttttctccatacaatgccacctgtaagaattacagtccaatagggaaatcaagagagacaacacatacttaggctaactagaaaataaatgcaatgtaacatattagtaagtactaaaagaggtgatatgacttggtataaatatgagccttgagaaaggcaaattggagagcacagcagcatagatgaaataatatgcttaaaatcttatttgattacaagaaaaataaatatataatgtcaaagagttgtgtcacctgaataagtgaaagccatgcacttttatttaatatttaatcacctaagaaaatgtatttcattttataaggttggtaaaaatgctctaccaagacctaaaacagttcaatgaaactatagactaatttcatttatgagtacagattcaaaatttctaaataaaagattaccaaattgaattaagcagtatattaaaagaatgatatacaaggacaaattgatttcattttaaaaatgtaaggatggttcaacatcaaaaaatctatcaacatatgtcttacatcaaccaattaaagtagaaagcccatatggtttttttttatcaatagatgcagaaaaaaaggcatacaattaagaagttatttctaacaaaaagtcaaagtaaaatcagattaggaagaaggtacttaaatgggataaagtcaatgtataaactgctgtactgaagccttgaattgaggattgataagaaataacatgtataaataactaagttgcatgactatgatgcaccaaaaaaaagaaaaaaaaaacttcttttatgataacatcatgagcctgtaaaccttgatgcccctgtccactttttcacaggtgaagcagaataaaatagagtaatcctgcagctgtcagctcctcttatacagtagggtcctcactcagctcagacaggtgaagccaccagccttggcaggtgcgccacaaggaacagtgtcacccagaccacaaacatgtgtagcttccttccctctgctatgtacacttagggtcactcatttatgggtttgataataaagcaaagtaaaagaagttgagtcttaatcatcatcctcattgacttttaaagatgggccaatgtttgatgtctacttaaaataaaccacagacaaaaagtataaaacagaggaaataaaataataatgaaaatatattcactgagttcatgttatgttctagaaattgctttcatttaattcttactacaactgtgtcagatagatgctattgtcattcccattttacagacaggaaaactgagaatgagggattaagtaatctgcataagattacataaggagtaagagttggaattcacacccaggcaatagggttctggagcctatgttcttctctacttctttacactgcaacaaatggaaaaaaagtgcaatcttcctggatggaaggacttaactccataacaagacaatccttccaaagtcaacatataaactgaacatcattcaaatcagaatgccgatgttttttgtttgttttatttcaaactggataaaataattttttattttttattttactttaagttctgggatacatgtacagaacgtgcaggtttcttacataggtatacatgtgccatggtgatttgttgcacctatcaaaccctcatctaggttttaagccctgcatgcattagttatttgtcctaatgctctccctcccgttaccctccaccccttgacaggccccagtgtgtgatgttcccctccctgtgtccatgtgttctcattgttcaactcccacttacgagtgggaacatgtggtgtttggaacatgaggtgtttggttttctgttcctgtgttagtttactgagaatgatggcttcaaggatgaagctggataaaatgattttgaagtataaatagaagactaaatgattgaaaatattatagaaaattgtggaagaataatgaggtggtactttctgtagtatgtaaacttactttaaagccattgagttataataatatggtattggcatgaaaaagacaaatggtcattggaaccaactagagagtttaggtatagataacgagtatttgttgaaatgacttattgtaggtagaatctgcattttatttcattggtaaagaatggtttgctttaaaaaatgataccagcccgaccaactatcaatgtgtacggaaaaaacagatccctttatcatatcatattataaataaattcccataaattaaaaatgttaatgttaaaaaagtaaaaatcttagaaaaaaaggagaatttcatgtaatctaaatgtaggggagcactttctaaagaaaaaaagaaactcagtagcttaaaaaaaaaagatagctatatgtagctagaaacaatctgattgattttctaaggcataaacttcccccccacccaccaaaaaaagttaacatccaaaagatagatctggaaagtacatctgtaacacatactacagacaaatcaatttcaccttaatatgcataggccttctaataatttataatacaagatactttaatagaaaataatttaggtaagaggatatattaggttggtgcaaaagtaattacggtttttaccattaaaaataatgacaaaaaccacaattaatttttcattcatacctcacataaagtcaagggagtgaaaattaattaaagaaacaagtaatattagcaaaaacgaatatcagtaatttcaagagtttgtggaggcacagatcacggataatttcattgtttatgataaagtgaatttccccaactttttaagaaagtagtatatcaataatgattaaaattaaacatgcattttccttttggcatggcaatacttggtaatctttccaatatgaaataaacacaagagcacatattgcatacattttcaaattttatttttagcataaaataatgtcagtaggattaacaaataatttgttttcaaccatgaaaggaatattatgcaaccataaaaaataatagggtgtgtccataatcaattaagtctgaaaagcaagttccagcataagtggtagagaactttttttctgtgaaaagtttttaaaaaataaaagagaaagagagagagacctaggatatgcaggagtatatttgctttgcttgtacgagcatacaaaaagtatggaagaataaacttcagactattaagttttcacctgagtgaaataaaacagagccacaattaatgtttcttgtatttatatatttgtactctttctctgtctgattgaaaaaatacaaatagaatatttgaaattaaaaattaagattaatatttttaaaggaaaggaagacattgtgaaagacaactttatttcaacaaatatttattgcacatcttgttctgtatgaatttttcaggggagtccatcataagaggaattactacactgtacggagtcaaatattcccacatgatctttctttatggtacatttttatcttctattgacaaaatactcttagaattatgcaatcttatgtctacacacgatggcaaggattgtctcatcacattagacatgagggttccgaggcctggagatgttaaatgttttgcctaaagccacaccgctttgagacatttatcatctcttagtccattcttaacccatatatcaatctttataaatgctcttattcatgaagttcttcaaaatagtttgatggagttaaagaagtgaggaagttgcttactatgcttttgggtgttactcttttcaagcctgaagccaatcaactaacctgcatgtctaagtttctgcttaaaatggggaactttgaaggtgccatgattctttttagagagacttttcagggatgtaaaagagctgctgaaagtcaatcgttccttaaacacttaaccggcaatttagccgtcctattttctgaagacttacaataaacagaaaaaatggaaacctgaatcattaagaaccactcaaataaaagaagtcattgtgataggaaagccatctctgaaataaacattttatttccagtgcaaaactataattctatttaaaagttttaatgtaatattattgttttaaagaacacatttcttgcttattcaggccaataacatgttcttttgtctgaatttttagggatgcaacaatatttcataatctttcttatgtacaatggatatacaaaaggtcataggaaattaaacaaactgaaagttttaatctcatatattttgaccacatatacaataataaatgtggtcttaagcatagaaaagaatagaatacaatatttagttaactggctccttaaaattcttggacatgggcagggcgtggtggctcatgcccgtaatcccagtattttgggaggcaaaggcaggtggatcacctgaggtcaggagttcgagaccagcctggccaacatggcagaacccctctctactaaaactacaaaaattagccgggtgtggtagcacacgcgtatactcctagccactcagggggctgaagcaggagaatcgctcgaacccagaaggcagaggttgcagtgggctgaaatcgcaccgctgcactccaggctgggtgacagagtgagacgctgtcttaaaaaaaaagaaaaaacttgaacacattgattaattgattgattgattgattgagatggagtttcactcttgttgcccaggctggagttcaatggtgcaatctctgctcagtgcagcctccgcctccctggttcaagcaactctcctgcctcagcctcccaggtagctgggattacaggcacctgctaccacacccaggtgatttttggtatttttataccttatacaaacattaattcaagatggattaaagacttaaatgttagacctataaccataaaaaccctagaagaaaacctaggcaataccattcaggacataggcatgggcaaggactaagtattaatggtttaaagtgttgccaagctctgacctgaactctcaaagtattctggtctaagaggcaagaaagccgtattcttcagattagtcaggttgaatttagctgtgatagctcttctttttttcatttctgttacaaataccaggaagctctctgagtttgaccttgactcattttccgggtccacagacagcattgcacctccaaaacaaatagcgtcctatatctgtgctacaacctttgctagttttagggtgtttttaaaaatattccccacatccaggcaaatcctctatgtttataaggaacacatctaaaacttctcttcatcccagcctctcttcttagaactctccaaaaagtttttttaagattcacaatgatttcatcccctgtagtataatttggtagatattggcccattgttaattataaattaccaaagtaatcatcaagcaattgtccaactagcatgtggtgagagcccttttgtcaccaattattagtaagaatactctttaaaaaatctcaggtcatagtcttcctggatgaaaccttctccctttgatttaagatagaaaattatggtcagtccttctccattttaatttctatattgctcctctttggtttgcataggggtacaaatgtacatataaatatgtcaccttgtagaaacctgtctcttaaagtttcaaaataactgtatgctagggaaaaaaatataatctaacaaaacatgactctaattactaactgaactccacctctgtgcacatggtactaagtgaatgtagagtttatccctgctatgaagaagcttacaggctgggacatgagatatatatcctggcatttatataaagagcactagaaggtaccaataaaagagatgaaagaggataacatgtaaataaatgatttttgtcatggcctgtgcacattttttaggatctctttccccataagaacatgagtgtgttaccactatgctcctgtagagtttagccagaaaagaaaataaacttcagacattctagaattctactacaaaatgttgttctttcttctgatgctcaagtccacatgttagctaagcacaaacatctttggcttccctttttcaaagctttctatacattccttatccctgagaagaggatgtgctattaatgctttaattgctaagttatatataaataagattcaggaactcaattttgcatcttcggaaaatatgaataatgatttctctttcccttcctccaagaaaaagtgacttatttggcagtcacactaacagtgcaaagaaatgagttctgatgtttcatttagttgagttataaacatgaaaaccatcaaatcctatgcaaccctattgaagcatgtggatgtgtgaattttctccatgtgtttgctctgtgtccttcagaacacccacagtggcgatgaatcgctaaggtgtgtatcagtctgacagtcgtagaaagtggcaagactgaaagccaaacccaggaaacagcatttcatttagctcctggagtactgctaattgatctcaaacccttcattactgtctagtccaaaggcctcaggagaatgtagccatttagaaaatgacttaactgaaaacaagagcaaaattctaggcctcgtgaacttcaattgctctattcctgtatcgtcacactgattctaagtttatctttcatttcaggtcacttggaaacccccactcatccagaacggagacatacttagctatgagattcacatgcctgaccctcacatcactttaaccaatgtgacttccgcagtgttaagtcaaaaagttactcatctgattcctttcactaattattctgtcaccattgttgcttgctcagggggtaatgggtaccttggagggtgcacagagagtttacctacctatgttaccactcaccccaccgtacctcagaatgttggcccattgtctgtgattccactaagtgaatcatatgttgtgatttcttggcaaccaccatccaagccaaatggacctaatttgaggtaagagaaggtgactatgatttttatgttgctgtagtccttatctctctgagaagtagggaaatgaaggaggcttttattcctatatgaacatagaactaatttggcattgaatatcccctgactcataactttcatacactatcatactgtacacttcaacttattatggaaacatcaaagtttatcaatttgaagaactaaaaacccttgaaaccacaatcactattgtctaaggattcgctacataatccatcacttcattttcaacatatgcttttattatatgttaggcaaacctgatgtaggttctatatgatacatttgcacaaatgtacctcagaattctaaggctaacacagtaattctttggcatgttgttagcttatggaaacttgtgaggagtgtggtcagggagcccgatacgatgaaagaaaagagctgtgattcagaaatggttttgcaaccacccaaacttgatacttggccaagaatacaaagttgataatattatcatcgtttataaagtattgatagtcataggaaaccattaacttgataagctttgtgtatttctactttgtgcgaaactggcagtaaagatttggcacatctaacttagaagaaatctaaaatgctatcattctgggagataatagtaaaatgcgaatgtaactgattcttcaaaatattaaatatatggaatttggtccagaaaaaaaaacgttcatctgaaacaaaaccacgtaactgtaaacttaagatgttattctttatgcttccacgcatatatcacacgcacatgccacagaacagcctgagttttggtaatctcaatatgagttgagataatcctgatgttcctgcttgtcttttgctttagatatgagcttctgagacgtaaaatccagcagccacttgcatcaaatcccccagaagatttaaatcggtggcacaatatttattcaggaactcagtggctttatgaagataagggtcttagcaggtgagattacaaaaactataaaaacaaatgctggcatttagttctgggcatgttgaatagttcaaagtatctcagtgtcttcattgtgtgagcgtgttatcagttatgcaataaaacatgtttggttattatctgtggcattaatcacccagctgtaacagtcagcatgtttaatgttttccatcttaactgcatgcttaaaataagccttttgaagttgaacttgtagatgttcaagccttaacctattgcctttgtcacggctccatctagacataaaacgttatggaagaatttggaaatattgaacacatacaaaatggggaaaattcctgggcacttgtagaatgcttgctatttctagaaatggcttataaatgaattataatgacttataattgattgtaagttattgattcagtccgcaaaagaaaacattagtgaacaggattgggacttgaaagaattcaatctagagttcaaagacattcagtaaaggctaataggtgacagtagaaaagggtgctacatgggagagttaggagatctggttctgctttagcctgtgctggagaactagctttgtgactttaggccacaaagcttcactacttaaaaatcacttaacttctctgggcttcatttttgttgtccataaaatgaggtgattttatagaattaaatgacttctaaatcttcatgagttcaagcaatgtgattaaatttcagaaaacatgaacgttattttatgaaaactcctcgatcatatgtttcagtaacttttctatgtgggtcattatttttctagacccaccactgggtagctgtagtctgaaccctgtttaccattctagccttgtctcccatccctttcttaccaaggcctctgcattccagccacatttgtattgcattcagtacctccaacatacaacacttgctctttcagcttttccccatagttgccttttcctgttgcctgactagatcatctgccacgtcttagcctggaggtttcttcctctaggaggcctttcctgccaacactcttgctggtctgattcagctcctctgtaacatttccataggacatcccctaacatatcactattgtcattgtagtgtactggcctgactgcttgtctaaacaccacgttatattatcagatctaccataaggcaggggtgcggtcttcgtgactctgtcttcagttcctagcatggtgtctggcacataccagcacatagtgccctacacctgaatacttaaaaataggttagctcaatcaagaattaattcactgctctgtaccttaggaatattagctgtagtgttcttctctctggggaatggcaaaactaaggaaaattctcctgtcctcttaaaaagttgtggtgggaaaacatcctagttcttgtaagattctcagagagaggcatctcgtaaatctgatcaagcaacagaatgaactatatgaaactgccacttttataggtgaagattggtcaattactagcagatccatgttgcttatcctaaattataatgctcattatactattctcaactacttttaattcattatttacttaatttggcatccctatatgattatcacttcagtagaataaattcatttatttttgcttatttgtgcttactgtgtgctgaggcactgtgataaggaacaaaagataaatacatcttagcccttgacctcaaagaacttataatctagtggaggaacccttccccccgccccctccatagagagtgtgatataatatgtatttttatatattatatacattattaattatatataataatcaatatatattatatatttatatattgattattatatataattaataatatatataattaatatatatattaattgctgtcctcagagttatctacaaagtcaccaattctgcctaaagaaatcacttcaaatagtagcttcctgtgacctatgaactcttaagtgcttaaatataactatttcaaaaaataaatagaacttgactctttaacattactgaatctgagttttagccatgagctactcagcaaaaacaaagaataagtttccaaaagttaattttgtttctttatacaagaaatgaaaacttattaaataattaggaccaaggccatgaagttagttatgaatttttagtgattcctctaaggattcttaatgagaagttcaaatctaagatttcaggaaaaaataaagtgaatttccacaacttaaattgaaacatgaattgacataaacacacccatgacagctgcttccggaagggaagtgtgcagataacaaaattgtgttaaagggatattttgactagtttcataatgccaaatgtcatttttttccggtagtacttgcacagattttttttatttattaaaataacagctacaacttacattaagcttgtagaaaaaaaaaaagcatttcttcttaacattcagtgtaaatggcgtgagtctttataagaatctctttttctagccctctaccctttataagtccataaaaagctaggagtgcctttagcccaagggggagtgtcttgcaaatatgagagaaaaccaaaacttgatcccctggcgggcaggatatttttctctttaaaggaagtgattttgtttggttagatggtgccactggccaccttggcaacatccggggctccttgttcctgctggtcagctagtggtctgtcaaattgcagagggggatgaagctgagtgttcatcatgtgttggttcacccctgtgttactgttccttcatggcccttcctttgcctatatttgttttgctgatttatttgtttggccaggtatgttttcctgggtttttaattgaattctaatatctttgggaggattatgtaatttcctattctccccagattccaccatcccaatttccttcttaacttaacgtctgcataaataaaaggagcactgaagtgtttcttaccatcttgacttgaatatcaccatagttacatttagaatcagcttttaaatggcacttctcctgatataaaaagtaaaattaagattcactagacatctctttatgaatatatttgtgacagtaaatataagttgaagccaatttcctagttcaagtggtctattttggctaagtatgtgtttataacgcatagaaaagcaccaatttaatttaaaacatcattatatttggaacttcagatcattctagtagttattttttcttttatatctacatgtacaaaacagtctcaagtcaattatccagataatttaattctaacaaaaatactttttgctcttatgattatcttaggtaaggagtaatttttgtctaaattgcacagctagttgcctcattatcgaattttgctctgcctgtgtagacacgaattccgtataactacaggtttatactgcttgtcagtttctaacttttcttccttaataattccttgcaaagtgagcaagttatggttgttgggggaactataactttgggtttcctgacattttcatcacttagaaaatctggcgaacgtgctgttatcatctgaagctgccgaagtgagtcaggcagggtttaacaagagggcggcgacctccttcattttaagcatcaatctaccttcacaattttcagcacctaacaacactgccttggttcctaagtgatcagataaaactgctaagaatacaatgagcatgttctccttttcgttgtggatttaaagaagaacaagttataataaacaatagggttattttactattatagagaaaatattgactgtcagattataatttagatttataaattagctttcattaagtttatgaaggaatgtatgttctaattgctattccttttaattatttatacatttctcagagtatttttttttttttttgcaatgacaatttggatggagacctctatgtgattcctcgagaatccactaattgtattacatttaaattaaaacattcaaaattaacacattttcgtcttatttttcaaagaagggtaagacttaagatgtaaatgcttaagctaaatatatcataaattctaagtttaaatcttattgacatatattttcatatatatttttaaatctactaaaataaagatgtttcaagtcctaaaagaggatgccatttctgtgggggataatattcaaaagaacataacttttgttcctcttctttgtaatgagattaaatatgtatagatgacatctgcatctttgctagtatgaaagactgggtcagttccatgacacgtgtttctataatataaataatgtcagattgtagctattaagtgaagaagttaactttgtacatagaaagggcaagtgaaaggaaagcttctcccgtgactaccaagatgagatagatcctgttaatttattccttaatatgggaatgtgaataaaaattgagtctaagaatgaaagccaacttctgtcaacactagtatgccatctcatagccatgcacttaattcaaaaggagtaaacatgtctttcacattcaaattaaattggtcacagtgttttttcccattggatttttttttcaatgccttacatgccctacacgatgtccttttctgtgtcatcatattatgtgttacctccttgtattagcccattttgcaatgctctaaagaaacacctgagactggataatttataaagaaaagtttacttggctcatggttctgcaggctgtacaagaagcctggtgccagcgtcttcctctggtgaaggcttcagggagcttttacccgtggtggaaggtgaaaagggagcaggtatgtcacatggcaagagagggagcaagagggcgctgggaggaatgccatgctcttaaacaaccagctctcccctgagctaatattgtgagggctcactcactaccacagggatgacagcaagccattcataagggattcacccctatgatccaagcacatcccattagggcctacattcaacattggtgatcacatttcaacataagatttggaggggacaaatatccaaactatatcactcatgaaaaatgaacttctaaatccagaaggatgtgttttgtcacaggaggtttttttcccctagtgttttcttagaataaaaaagcagaaaaactactttcattggctgtatttctttctcatggtgatgacaaagtagaacaaagatggaaattactgcaaaattatcttaggtctgacaattctggtagtgtagatatagatagcaacagaaacataacagcttcaagtttcactcacaatctaaaatgtctcatattaaaaatattcaagtgtgatcaacattactcttcaatttttgaagcaaaaatcttcaatactatttttagaatcaacaaatagattttttaaagtgtctaccatcagctgaaaattttaatagctatagacttaagcaatggaaacaatattgcatttcatttttctttgtttgctattcccacaaaagatttgaagatgtaaggaaaagtatgatttatgagatttctcaaatccacacttgtgtgatggtgtactgaaaaatactttgggttgtggcagagatgaggaagagttagtggaagaagcaactaaataacctgcattttcagaagcgtgatttatattggtgacaatattaacacatgaattctgttaggacatcaataaagttgacacatttttaattctgatgaaaataaccccaggcattctgcagctgccctgaagaattttggtttcccacaatatatcagtcccttccaagatacaagccttcacatattttgccctggacaaatgtcttcactggataaaataccacttcttatcaaaacctgccccaaatgttacctcctccgtgaagacttcccagctggatatggttaaattagatgcttcatctgatgcgtgttcaaagaataaggaataaatgaataaattagatgttctcatttaaaaacatatttctgtaaaattttatatacattatggctccaggtggacagataacaattttattatttttaacacctggcatattggtaatatccaataaatattaaatgaatgaacaaatgaatgagtgaagtgatgtattaaatatgaaaaagcaatataatttgttttcaatatatttttaaaagcactttgctaagtttcagcagagatattctttctattggacaggtagatttttatctcactaacctaaaaaattatataagtgacctgaaatttttgagactgagtgcttaaataactatgaaacatctattcattcatttataaaattatctattcagtaaataaacaaattaaaactgcatcatttaaacataatctagttttctaattcattggagtaataacacctgaaccttgaaatgaatattgttccacaagtaagattttaacacatattattttttatgaggaaaattaccatagtcatgtctataccataataaagtttacaatttgctgtttggggagtggaggagggagagaccggaggatggtctcaagcaaatgggggaaaaactattgtaatagtccaagtattcctaaatggacccaaaaacaattggttttactggctacatcatagactcaatataagtattcacttactttgaatacttatattgcaaaagttttttcctacagagtttaaaatggacatttttcaagacatgcctagagaacacactttgtatttagagaagaaattgattgatacacataagttttgtcataagtatatgatgttaattgatctagcatttttgttttaaaatgtattcttttatcatttattaaatggaatgtcccatttaatatcaacaatcaacacgtaagtccatttgaaaaacagtatacatagagtgaatggaaaaccacttcaagccaactaatacattctttttttgatatgaagtggtgaaatgtgaatcaacatatatatgtagacaagccataggtatatattcttactaaatacagattggaattcagatgaaatgaaaacagtatattttagtatttaagaggattcaggatcttgtttcctcggccaggcgcggtgactcacgcctgtacagaatcccagcagtgggaggccgaggtgggtggatcatgaggtcagaagatcgagaccatcctggctaacacgatgaaaccccgtctctactaaaaaaaaaaaaaaaaaagctaggagtggtggctgacacctgtagtcccagttactctcaaggctgaggcaggagaatggcgtgaacccgggaggcggagtttgcagtgagctgagatcgcgccactgcactccagcctgggcacagagcgagactccgtctcaaaaaaataaataaataaaaaaaaaataaaaaataaaaaaaaaatcttgtttccttaaaaatttaacttaacaatgaaagttaaagtacaaaagacaaatgtacggcctcaaatgaaatatctactgatttctcaattaaatttttaaaaagtggaaatagtgtaatattggaaatgaataaaccctatgtccagctaccccattaactagttgtgcaaacttacacaaatccacttgtttctcagggtctcagggttttttgtttaatctgtatgatgtagcacacactttattatttgtagcagataaactctaaagccatctcttactctaaaattttagaaccaccttgaaaacaggcatgcaattgtgtgtatctatgtggcctgagttttgtagacgtaaattgtgtatttcgccataactaaattattgtgaaatctcttaaagtattataaaaactaaagccctatagaatttatttacaatcaaccattttagcgccacctgatattgttaattccacatgtaggaaagaaccacaaacatggtatcactttaaatccataaagattattaattgtataatagcatagacatgtggaagaaaaatttacatattataggagaggaggctaggtatccagactctagctacatttcttttaagtcattttatgaagtaaaatataattataagtattttacccagggagagagctaatgaagccaaggtcgctggttcaattcccttgtgagccattagcttcatttcattccattgtcataggcttgctaccctcttaaccccgactcatcatccttcatattcatactattggttgcaaaggaaatttggccagactgtttgaatgtgtaagcaaaaatctattccctctgctagaaaaataacgcaaagttcaagccttagtgatatgacatcatccaagtatggacagaacagattatcattatgattgttattattactattattattatcatcactattatgttggcagtatagcatcatggttaaaagagcaggctctgaaatcagactgcctatatttgaatctcagtcctcctacttattatctcaatgacttggacaagttatttatctctctgagccttgtttttcttattttcaaaataggtattataatagcaccttatagagttttgtgaggaatgaatgggttaacatctgtagaaaatgcctgacagctattaagtaactattattattttttagttgtctggattatgtggactattcagcacttgctaaaaagcatatgtattcattttccagggctgcagtaacaaaatatcacatactgggtggcttgaaacaacagaaatttattctctcacaggtctggatataagaagttgcaaaccagtttgtattctggaccagactcccttccaaagctctgtagaagaaccctttcttgcctcttccaacttctggtagccctaggaaatccttggcttgtgacagcataactccaatttctgtttctgtttttacatggccatcacctccctgtgtgtatccatgtgtctataaaatttctctctcttttttcttccaaagacatcagcattgaatttatggtgctgcctaatccagtatgacctcatcttaacttgattacatctgcaaaaaccctatcttccaataaggtcgtgttcacagggaccaggggcttgggcttgaaaatatctttttgaaagatacagttcaacccactacagcagacaaagcagaaataaaagaggcattaaacacctgagaagagatggtaaagcagggaggtgtagaagatctgatgcaagcacatatttaggagaaatagataaatagcctcaaaaagtcactaagttttacctgtaattacaatagagcaacacctttcaatgtgggtcaggcagaaacctgcaaacgtatcttcgggctatgaataagaaacaggatgagtcaagcagatttcttctacctaggtggcagtaaaatgctctgaggatcctgatataattttggtcaaattatttaacacaatcctgcaaatggcacctacccacccatgccacaccacctttgcatcgtcaaatcagagattgtgacatattgagacaaatactgtgggccttacactggagatgaggtatccttgatcatctaataaacccaaattaggtaatgatctgaggccagtgtttgccctgtgtcctggatgcctctgggatggtcgtgtgttgcactacatgtttaagcaagtatctcagtctaagctattgtccactcatagactgactgtgtctgtttatggcatttccttacacaggtagttctgaaccaagcaaaggaagcctgatggtcttctgcccaaaactggttaaaaaaaaatggtggctttactctatagtcaatttaataaatgacttggaaagtcctcctcatatcacatcagcatgtcagtttttgccttctgcaaagtaatattcggtttccactgtattgactcaagtaaatatgttcacactatggcaaaatacagctcactgtagcaaaactctcagcgggagaatgttgtacactttggtcacagttacaatttaatttaggggtttatctgtctgcagtgagattatgggaaagaagcataggtatcggaagaaaatgttgatgagggattctgatatttgaaaatggatgagtttccaaaaagaagagcataaaactctctggatcaaattcagatagaaagctggcaggttgcctgatttgtaattgcatcttgaattgagctgtaatcctcaccacttctgaaaacaataagaataagaaaatgataaaccacatttgttttcaatagcaatatttgttcagcattcctaataaaatatttccctgatgttttggtttatgctggcaagtcacaaaattaatgatatgtgttgtgtaaggagggaaaataaaataatgtattttctagggaggaaaagaaaacagtattttgtagaggggtggaaggaaatcctgtattttgtgaagaaaaaaagaaattatttgttagattttctgtaaagtagaaattcatatactttttttaacaaaacaacattttaggtttacaacctatgaatatatgctcttcgtacacaacagtgtgggttttacaccgagccgagaagtgactgtgacaacgttagctggtcttccagagagaggagccaatctcactgcgagtgtccttaaccacacagccatcgacgtgaggtgggctaaaccaagtaagtaagcttctcatacctgtgttaacactttgtgtatttttaaaagcatattctttctttactatgaacctcccccatgtacacatcattttgatagtgaagtgttactggtaaatttttaccaattgcagattgacagggctgtcattgaaaactttagaagggccatttttattagtacccaaataaattagaaatggacacattaaaactaaaaccctggggcccctgtgccattcttaagatgcaaactctctcctactttgacattgttcttgggcctcctgctctccctctgtcatttcctttgcatgaacaacgtaatttctatcataccaggcaattgtgatagacatgtccatgtattaattggatacaatgtactattgttcaccttccttcagagagctctgccctaatatcttgtaactcgtcgctcattagcaagaaccatttaattggattgcaataatggaacagattcttcccagtggatcatcttcagactggctatgggcagaattccagcttgatccagtaaaaggaagcctagacatcaccactggatccacttaaataatgcagggtcgaccctggacctgctgggaacacttttttaacaggcatttggaagagttcacagagtaatctaatctgttcctgcaacgttagaaaccacagtaactgaaatttcacagttacttggtcagtagggtagtattaacatgttaatttgttgtgatctgttaatttgtgtcaatccctgacgactatcaggaaaaaaaccctgaatctaccatgagaatatgtattaaaatcagtcttataggtataacttgagatctggcaaatagtttcatcaaaacttgtcagaataacaccaaatattgagaaatacctgatcaggaaagacccactcaaaacattttatttatgaaagaacactctgctcactggggtaatcatctattgatgatataaaaagatgaaaagtcactactggttgggcaatgtaaccatgtgattttggttacactggatcagccttgaatttggttacagcttaagaagagagatgctccatttaggacacctgagtgatatcaattgtgaattaaagccagaattgaggatatcaattgtgaattaaagccagaattgaggatatcaattataaattaaatcagtaggttaggtttatctgtgtttccacaaaataatccatctttacaaaagaaaactgtctttctctggtttttataaggctgcaggtttctaatgatctgtgacacttgtattgggatctcttaaaccattttaatggaataatataagttaattgatgcttatggctaccctctgaaacacctctgggaaaaatacaaagtttttatctggggatgtgttttaaggcatatttccattcatctccctcttgctctctactccacctcactaactgattcatcttaaaagcctactcataaaggtaggctctcccccctcatctgacatttgaatacttctgttaagatccggctggtgaatttccaccaatataggtcctttatgttataattgcattcctgaagtaactgtgcttataaaaactgacaaacctaatagatctgaagcagctcactgaagtttcattaccttggtaatctgaacctctgaccttcgggatgtaggtaatgcaatctgctgttatttccattcataccttggaaatttttcagataactatttgtgagcacaaaggttaactctcagaagagggtcagtcttgcgaaagcttgttgcattatcattttcttcttttgggcaacttgctatcttaagtaaattaactagtcgatcctctgtgaaaggtggcctattttttgcaattttaattttaaattgttgtcttgattggataggaaaaacatggcatacagtctaatatgctcaaaggcaacaaactatagattgaaaatactttgcagtggaaaatcatgttttaaatttataaatatttgcttattaaaaatcaccttccaatgtatatatatatattttaaagcatggtctttgtctattatgaccctccccatgtacacatcattttggtagcaaaatgtttctggtaaatttttatcaatcacagattgatatgtataagttattaaaaacttttgaagggccagttttaaacattagtatcacatacatgatatgtgagataaaagcgtccctgtgttacttcagttcatttttggaaggcagatgttgcaaattggcaacacagtggccatatttccttcctcctccagcttccatacactgttttgcccacagtatttgaaaaaataatatttgcaaacatttaagaattatacataaagataatttgaggattcacttgacaagtcaaatgatggggtgaaacaatacccacatttctggaaggaaactatcagctggaactggcttcccctttagacagatcatgccctaaaaatctgacccggtccccattttcctggtcccaatagacaggtgatgtttatccctgctttatatgataatacaaaatattttgccctaaacaaaatacaccaaagataaattatattgtaattttgaaaaatcacagtttttgtatttgaaaaatacctcacttaaattatttatacaatcctcagaaaagcacaatgagatagaaaccagcccatagtaacttaccaaaaattatagaaagtaccagttcccaaactcaaacttaggactcaggcatcaaattttctatttctcatgcgtttagacttaacagtcattaacactttaacaagaaggatttaaaaggatccttctcatcttgactgctcagtctaaaatagaaggcaaaataagaaaatgcctaccaaagggagtacagtggagagatagtgcctcctttgaagctgattcactaaggaagtcagttgtggccagaaaagagcagtaaaacactggagggagtgagagggcaatgctttgtaaaagaggaaatgaaaaatcatcaaaatattgtctactttactgtctgtcaagagctcaccccaaccttcagatgttcatatcttgtatcatataatcctcctggtcttgctctctccttcctctttttttccatcttccttctttctctatttccttttttaaaatgtttttgtagagacaggttctccctatgcttaggttagtctcgaattaatgggctcaagtgatcctctctccttggcctcctaaagtgctggaattacagccataagggaccatgcctggccatttgtctatttctcttcttctaccctctctctctctctctctttcttcctattttccttccttcctcacagatacatttatcactttctctgtcctgagcactcagtgaactctggaaaatgcataaagtatgagggtatcatcattaagagggcaagtttaaaaccacagaaaaagcatttgtctcatcctgatctcttaatcagaaactaccaggtttgatagctagaagtatatctgactttgcctgaatttatctgattaaggtggcaatatctgtaaataattccaaatctcatctcttctaaaaagcacctaccattgttgcctcaccttgttcctctgttctcttttccatcactttagttatcaaatagaagagaccacatctgacttttccattgtcttccttctcagtcacttgtgcacctgttgtaatctgtctctcttcacttgtactctacatggttttcttaaagtcattagttatcacctaatgacccatttcaaaactctcttctcaatgccatcctactgtgttcctcttgtatccagcactgtgaatgatcccttactgactataattcttccccaataatcattactcccctcttctcaccaactacttcttctcatccctaaagatgtttctcaaagttctttcctgagtcttcctatcatactcctgttctcttgttggtgattccatctatactcaaggtttcaaattcttctaattacaaaaatgacaaccgccaacattgtatgcagccatatgaataaatagttttaaaatagactttgggatcagggatacttaaatttgaatcccagttccaatatgttttggcactacgacctagaatttaacctgagttccagttttctaatcagaaatatgaagataataactgccctgaaatctgttaaggactaaatgaaataatatatgtttaacaattagtaatcacctagtatttgtaatacagagtattattctatttctaaaatgtgcatggtcctttcaataccattttatataatatataaaaggggaagccatgtctagtaaaagcttggaagttgattttgcaagactattcagataaaagcattttttttattattattatactttaagttctagggtacatctgcacaacgtgcaggtttgttacatatgtaaacatgtgccatgttggtgtgctgcacccattaactcgtcatttacattaggtatatctcctaatgctatccctccccactccccccaccccacgacaggccccggtgtgtgatgttccccttcctgtgtcctagtgttctcattgttcaattcccaactatgagtgagaacatgcggtgtttggttttttgtccttgctatagtttgctgagaatgatggtttccagcttcatccatgtccctacaaaggagataaaagcatttctacagtgagttgaagatgcataaagaatatatgttattttataattacctgacttggctaaaagatagaaatttaaaaatctagttaaaatgttgaaaacttagtctgggttccatggctcatgcctgtaatcccagcactttgggaggccgaggtgggcggataatgaggtcaggagatcgagaccatcctggccaacatggtgaaactccgtctctactaaaaatacaaaaattggccaggtgtggtggtgcatgcctgtagtcccagctagtcgggagactgaggcaggagactcgcttgtacccgggaggcggaggttgcagtgagccgagatcgtgccactgcactccagcctggtgacagagtgagactctgtctcaaaaaaaaaaaaaaaaaaaagcgaaaactactaactattgcatggcatccattctcctctttttcttttagtgatagccttgccccttatctagaaactgcatttactaacctcccttgcaattagtcatggccaggtgaaataccagtagtatgtgtttgtgtcaatagaaagtgaaagacaatctgcatctttttgggtattaaccagaaaacactgggtgtgtgcctacttgttctcttttagcccttcccctggactggaatgaggacatgatcatgttctcaggttcaactatgcagtcgtgtacaacacccaaagagatccaaaatccccataagagaaagttcctgggttcttaagtgaccacatggagcacagtctgttttgatcactttgaagctattacatgagatacaaattaacatggattttatttaaactattatattttggagattttaggtttcaccagcttcgctaactaactcattccctgtttgcccatatcaatttaccttaaaagtagaaattagctatcctgttttttaactaaatataaaatgatgaataattaatatatctattatactatctcctttaaatacagttttctctggcaggcccctgatagaagctggaacactatgagagactaaagtagctctggagtttccaaagtgcaggtgtttggttttgacagatgggtaaactagagacaagacaggagatatgctgctcggaaaactaaggaggctgacttgaaggattattgcccaagaagttaatctttccacttcatgtcagcagtagtaccctcaggcagagtaaagaattttctcaagagcagttttgacaagctcaaattttccaagagctgcttagttggtgacgcagagccctgcaccatagaacttggaaaattggactctaatttggagattctgcgagcaagatcaagacttccatcataaaatcagcttaataaggtccttccaggtttttacatttgagcaacattacctcccaaaatgagcctgctaatgtgagatgtctgaagaatttagtcctagacaaataaattaagagatctaataaatgaaatgatttactataattgatctgaatcagtacaacaaactttttttgtaaagtgtcaaatatgtataatgttagactttgaagcccatacagtctctgtcttaactcaaatttgccactggagcacataaacagcaataaggtgattctgatttttaaataagcatggccatgttccaataaaactttattttggacattgagatttgattttcatatattaggttggcacaaaagtaattgtggttttcgccattgaagtaatggcaaaaaccacaactactttgcgccaacctaataattctcacatgtcatgaaatactttttttcttttgtttttttcccccaatcaaataaatgtacaaaccattcttagcttgcagggggtgggccacactaggccaacaggccagatttagctcatggaacatagcttgctgacctctaatgtagatgttaaaaatctagaagacataattgacattgataattgtcttggtctgtttgtgttgttataacagaatacctgaggctgggaagtcaataaggaaaagagttttgcttagctcatgattctgcagactgtacaagaagcatggctgtagtatttacttggtttctggtgagggcttttgtgatgcattaaacatgacagagaaggtcaaaaggtgagtggacatgtgcaaagatgcaaaatccaagggatgcccggctttctaaaaacccactcttgagggaactaattcatttcttcaaaaactaacccagccttgccagagcaagacaccaagccattcatgagaatctggccccatgcaacaaacacctccaactaggcctcatcttccaaaactagtacactggaggtcacatgaggtttggtggtgatataaacccttgatccccctttgctgggaaccatggcaataatttaaggccatgtaagaagcacaatctacttgctgttgcaggataacttttaactagcccgtctgttatggactaaagccctaattctcagtgtagctgtatttggagacggggcctctaaagaaatacagtcatcccttggtatatgcaggcgattggttccaggactgccccctaagtacaccaaagctgtgcatactcaagtccagcagtcagccgtgcagaatccatgtatatgaaaagttggccttctacacgagttttgcatgggagaatactactttattttttttggagatggagtctcattctgtcactcaggctggagtgcagtggtgtgatctcggctcactgcaacctccacctcctgtgttcaagcaattctcctgcctcagcctcccaagtagctgggactacaggcacatcccaccacgcctggctgattttttgtatttttagtagagacggggtttcactgtgttagccaggaaggtctcaatctcctgacttcgtgatcctcccgcctcggccttccaaagtgctgggattacaggctagagccaccatgccagctgagaatactatattttcaattcttgtttggttgaaaaaagtccctttataaatggacccaagcagttcacacctgtgttattgtgttgttcaagggtcaaccgtaattaaggttaaatgagattataagagtgggacctcgatttcataagttagcacacaggctcgcttgctctttctctctgtctctcccccaaccccttctctccctttctccgatcacagaggaaaagcatgggaaaactcagcagctagaaagtagctctccaaaagccagggaaagagccctcagcagaaactaaatttgctggcgccttgatcacgaacctctagcctccagattgtgagaaataagtttctgttgttcaagccacccagcctttaatattttgttaaggcagcccgagcaaactaatacatatctaactactgttaaaattatttaggaattcattataaaggagaggagcctgttctatatttgagaatttgctccagctaagataaaatttctgaccaaggattggaggttgcaactaaaaataacatttaatagcaaagctcttatccaaaaaggttacaacctttttcagctcactgagattgtaatagtctgttctcacattgctataaagaaatatgcaagactgagtaatttataaaggaaaaaggtttaattgacccacagttctgcatggctggaaaggcctcaggaaacttacgatcatggcagaaggtgaagagacgacatgcgagataggtgagagagagaatgcacacataggaggaactgtcaaacacttatgaaaccatcagatcttgcgagaactcactatcatgagaacagcgtgggggaaaccacccccgtaatccaatcacctcccaccaggtcctgcccttgacacatgggtattatggagattacaatttaagatgagatttgggtggggacatgggacctaaccatatcagagattaacttgatattcccacaagtagggcaatacctgctcagataaatttatgtggtccacaaaatatgcatcatacataataggattagaatatctgagaaaatatatcccaatatacacatatttaacataatctcacaggaaatcccgatttctttctattgcatcaaatacaagcaagtacaagccttaactccatattgtataactgtaactcaaacattcacattgtagtttttaagttcacctagttgccacagaaacacttgaaagataacaaaatcctaagctccaacaaccatctgagtggatccccacttggccaaggggacaccagagcaaccttgaaaactgagttcttggctacagtgggatgggaagtcagacacccctccctggctatacaccattagggttacttccctaagtgctaagcagaaaccaccctttcaaaagattccaccactgatatcaaccaaccacctgatgctgcccctcttctactaactgatgagagacctctggccacagagttgtcatggccagtgtatggagaatctgcagtcagggtcttcatgtcctcttcttcactgcttgatgtcagagggctgaaaactccaccctcagattgtgctaatgctgccatttttgtacgtgggatgcaccaggggatgtaaaactcaattgcacatgtgcgtgtttctcctttcataaatactcatgactcttcctgaggcttattgaatatgtatattcagtcaccccactcagcataaattcctgttgctcctcccttgaagaatcttttctggcttctggcttaaggctaccatatgcttcccaggctgtctgaatggccatcctgcaggctgcaaccctttatgagaagtaaagctctccttttcaaatttatgaacctcttctgttgacacacttcaaactcaagaagtctcaaatgaaacaagtttcaaaatctcatcccataattccatgttttctatcttatttaatgggattcacccagaaactaaaaccaaaaatctaagctatagctgtatctcttccttatccctttttaatttgtttatttacttatttgtacacgaataagttctttagtggtgatttttcagattttggtgcacccatcacccaagcagtatacactgtacccaatggttagtcttgtatccgttgcctcccttccacccactcccccgagtgcccaaagtccattgtatcattcttatgcctttgcatccttacagtttagctctcacttatgagtgagaacatatgatgtttggtttttcattcctgagttacttcacttagaataatggtctccagttccatcaaggtttctgcaaatgccattattttgttcctttgaatggctgatacacacacacacacacacacacacacacacacacacacacacacaccaaatttttttatccactcattgattgatgggcgtttgggctggttccatgttttcacaattgtgaactgtgctgctataaacatgcatgtgtaagtatcttttcatataatgacttcttttcctcttggtagatacccaggagtaggattgatgaatcaaatggtaaatctacttttagttctttaaggaatctccacactatttttcatagtggttgtactagtttacgttcccaccaagtgtaaaaatgtgttctttgtatcacatctatgccaaggtctattattttttggttttttgattatggccattcttgcaggagtaagatggtaccatattgtggttttcatttgcatttccctgatcattagtgatgttgagtatttttcatatgttttttggccatttgcacgtttcttggccattcttcttttgagaattgtctattaatgtctttagcccactttttgacttgattgtttgtatttttcttgctaatttgtttgagttgcttgtagattctggatattagtcctttgtcagaagtaaagatttttaagactgtctcccactctgtgggttgtctatttactctgctggttatttcttttgctgtgcagaagctttttagtttaattaagttccaactatttatctttctttttgttgcatttgcttttaggttctttgtcacaaagtctttgcctaaactaatgtctagaaggatttttccaatgttatcttctagaatttttgtggtttcaggttttagatttaagtctttgttccatcttgagttgatttttgtacaaggtgagagatgaggatctagtttcattcttctacatgtggcttgcaaattatgccagcaccatttgttgaataggttgtcctttacccactttatgtttttgtttcttttgtcaaagatcagttggctgtaaatatttggctttatttctgagttctctattttgtttcattggtctatatgcctatttttataccagtaccatactgtttttgtgactatggccttttagtatagtttgaggtcaggtgatgtgttacctccagatttgtccttttagcatagtcttgctttggctatgtgagttcttttttgattacatatgaattttaggatttttttcaagttctgtgaagaatgatggtggtattttgatgggaattgcattgatgggaattgtgttgatggtaatttgatgggaattgcattgaatttgcagattgcttttggcagtatgatcattttcacaatattgattctacccatccatgtatatgggatttgttttcatttgtgtcatctatggtttctttcagcagcattttatagttttccttatagaggtctttcacctccttggttaggtagattcctaagtattttactttttatttttgcagttattgtaaaaggggttaagttattgatttgattctcagcttggtagctctttgtgtataacagtgctactgatttgtgtacattaattttgtatcccaaaactttgctgaatttatttaacagttttagagggtttttggatgactctttagtcatccaaatgtctctagggttttctgggtacacaatcatgtcatcagaaaacagcaacagttggacttcctctttagctatttggatgccctatatttttttctcttgtctgattgctttggctaggatttacatactattgatataggagttaaaaagaaattaggcagatagggatggtaagagagtcctcaataaggttttccttttaatggagagcagcagcccccaaattatctcttttctgacaaagagcagcctgttaaattgaactgcagacatagataagcaagctggaagcttgcatggatgaatgccagcagctgcaccaacagaaaaaggctacctgggggcaaggcatgttcaacatagtggctccatctgcccttttctttgtcgagcacatgtacagtaagaaacagacaacatggcactggccaggtagagaacccatctgcataacaaaagattaggatggggtgaccaggttattcatgcactatgtaaatggcacacacagtcccatcaatctttaggccctatgtaaatcaggcactgcctcctcaagccagtctataaagctccgtgcactttgccgtggactggaagacccatttgggagcccttctttctctgcagaagagagagctattctcttttctctttcttttgcctattaaacctccactctgaaacttactgtgtgcctgcatccttgatttccctggcatgagatgatgaaccatggatatttaccccagacaatgatgctgcttcagtatgttgaataaaagtggtgaaagtaggcatacttgtcttgttccagttctcagggggaatgcttttgatatggtttggctgtatccccacccaaatctcatcctgaattgtagctcccataatgcccacatgttgtgggagggacccagtgggagataattgaatcatagggtgggtctttcctatgctattctcatgatagtgaataagtctaatgagatctgatggttttataaaggggagtttccctgcacaaactctcttttcttgtctaccgccatgtaagatgtgcctttcaccttccaccatgattgtgaggcctcccaagccatgtggaactatgagcccagtaagcctttcttttgtaaattgcccaatctccagtatgtctttatcagcagcatgagaacagactaatacagtaagttggcaccagtaaagtggtatgctgctgaaaagatagccaaaaatgtggaaacaactttggaattgggtaacaggcagaggttggaacagtttggaggattcagaagaagacaggaaaatgtgggaaagtttggaactccctaaagatttgttgaatggctttgaccaaaatgctaataatgatgtggacaatgaaatccagtctgaggtggtctcagatggagatgaggaatttgttgggaactggaacaaaggtgactcttgttatgttttagcaaagagactggcagcattttgcccctgccctagagatttgtggaactatgaacttgagagagattatttagggtatctggcagaaaaaatttctaagtagcaaaacattcaagaggtgacttgggtgctgttaaaggcattcagttttataagggaagcagagcataaaagttcagaaaatttgcagcctgacaatgtgatagcaaagaaagtcccattttctgaaaagaaattcaagacagctgcagaaatttacataatttacctaagtaatgaggagccaaatgttaatccccaagacaatggggaaaatgtctccagggcatgtcagaggtcttcatgacagctgcgaccaacacaggcccagaggcctaggaggaaaaagtggtatcaagggccagacccagggttcccatgctgtgtgcagcctaaggacttggtgccctgtttctcagtggctccagccatggctgaaaggccccaatgtagagcttgggccacggcttcagagggtgcaacccccaagacctggcagcttccacatgatgttgagcctaccagtgcacagaagtcaagatttgaggtttgggaacctccacctagattttaaagtatgtatggaaacacctggatatccagatagaagtttgctgcaggggcaggcactcatggaaaacctatgttggggcagcacaaaagggaaaaggggtgggtgcctccacactgagtcctcattggggcactgcctagtgctactgtaagaagagggccactgtcctctagaccccagaatagtagatccaccaacagcttgcactgtgcacctggaaaagcacagacaatgccaacctgtgaaagcagccaggagggaagctgtaccctgtaaagccacaggtgcagagctgcccaagaccatgggaacccacctcttgcatcagcatgagctggatgtgagacatggattcaaaagagatcattttggagctttaagatttgacttccctgcttgattttggacttgcgttggggcctgtagcccttttgttttggccaatttctcccatttggaacagctgtatttacccaatgcctgtacccccattgtttctaggaagtaactaacttgcttttgattttacaagctcataggcagcagggacttgccttgtctcagatgagactttggtctgtggacttttcagttaatgctgaaatgagttaagactgtgggagactgtggggaaggcatgactggctttgaaatgtaaagacatgagatctgggagggaccagggcagcatgatatggtttggctgtgtccccacctaaatctcatcttgaattttagctcccagaattcccatgtgttatgggagggacccagtgggagataattgaatcatgggggcgggtcttttccatgctattcttgtgatagtgaataagtctgatgagatctgatggttttataaaggggagtttccctgcacaagctctcatttcttgtctgccaccatgtgagatgtgcctttcaccttctgccatgattgtgaggcatccccagccatgcggaactgtgagtccattaaacctctttcttttgtaaattgcccaatctcaggtatgtctctatcagcagcatgagaacagactaatacagctttccacttttccccattcagtatgttagctgtgggtttatcatagatgacttttattacattaaagtatgtcctttctatgcctattttgctgagggttttaattataaagggatgctggattttgtcaaaggctttctctgcattgattgagatgatcatgtgatttttgttttcaattctgtttatggggtgtatcacatttattgacttgcatatgttaaaccatccctgcatccctggtatgaaacctacttgatcatggtgaattgtctttttgatatgctgttggatttggttatctagtattttgttaaggatttctgcatctatgttcatcagggatattggtctgtagttttcttttttgtcatgtcctttcctgtttttggtattagaatgatattggcttcaaagaatgatgtaaggagtgtttcttctttctatatcttttggaatagtgtcaatatgattggtacccattcttctttgaacatctgatagaattccgctgtgaatctgtctggtcctggactttttttgttggtaacgttataattaccatttcaatctcactgcttgttattggtctgttcagagtttctattacttcctggtttaatctaggagagttgtatatttccaggagtttatctaggttttctagtttatttgcataaaggtgttcacagtagccttgaatgatcttttgtatttctgtggtatcagttgtaatgtctcctgttttatttctaattgagcttttttggatcttctctcttcttttcttggttaatcttcctacatggtctgtcaattttatttatcttttccaagaacaggtctttatttcatttatcttttgtattgttttggttgtttgtttcaattgcatttagttctgctttgattttggttatttcttttcttctgctgggtttgggtttagtttgtacttgtttctctagttccttgaggtgtgaccttagattgtctatttgtggtctttctgagtttttgatataggcatttaagactatgaactttcctcttaacactgcttttgttatatccaagaagttttgataggttgtatcactattatcattcagttcaaataatttttaattttcttcttgatttcattgttgacccaatgatcattcaggagcagattatttaatttccatgtattggcatcattttgagtgttcttattggagttgatttccaattttattccactgtgatctgaaagagtacttgatatgattttaattttcttaaatttgttgagactcattttgtggcttatcatatggactatcttggagaatgttccatgtgctgatgaatagaatgtatattctgcagttttggggtagaatgttttacaaatatctgttaagtctatttgttctagggtatactctaagtccattgtttctttgttgactttctgtcttgatgacctgtctagtactgtcagtggagtattgaagtcccctgctattattatgttgccctttttaaactcctatgtgtcaattaaagacaggctttttccatctagtgaatccaccattccccagggccttagagtcctaccttagatgggaaaactagaccctcatagacggccaattgctccttcacatctcagtccagatgcatggggcccagaaaatgtagttcaatgatttgacaagaagagaaaaatgttggtattagggagttctagaaatctttgccttcagattacagaagatagcttttatcttccgactatattttaaaatttaaatggtattaatgatattaatggttactaatgtctttctctgttttttcatgccattctattttatatgtaataaagaacttaatatgctgttacttttcttgcctttctcatctgctgttttcaatgttcagtttattattattgttaatattgttgttatgatataatttttttatgcaactattttctctaaatagcttcagtacttatcagcaattcttaaactttcccaatcttgagttctggatcttgattaatctttctgtcttctgaagaagattattggatagttttatcatgaaacttaaaaagatcaattaattagttttatgttctctaaatgtttggtgatataagaaagtatttctctcatctttgcacattctcttaaatttgcccaaataagaaagtatgtctgttgtttttacacataagtaaccatttaaatgtgtataaaattcttggattaaactatttcccctcaaaacttgttgaaattgttccattgtctttcaacatttgacattccacataagaagtttgaagcttatctgatttttttctcctttataaatgttcctaatttttggtttacctttaaaatgtttcaatattccatgatatgtctatgtttggatatattgtgattattttggagaaaactgtattagtctattcagtttgtagacataagtcattttgggtaaggtttattggggcatttcatatccataattatttattgcatttatttttaaggtaattagactttttctgttctcgatgtctataatttttactttcactgatgtccttgtcattttcctgttaattctttgatattgtgcatttttaactctgctcatttctgctttcaacgtacgttttaattctgccattgctttacatggttccttgctctcctttcttatttaaggcagacccctttacatctctgtctttgtggctgtctttttatgattttacaaacctacttcatagaggcttctttttcataaagtaatgtcccttttttatttttggtacaccatgcaaatattttataaaacctccatcccattgtcatagaagtaatatacacaaaacttctgccttggaaggttctagacaagatttcccttgtcttatgctaggaagaagccttgtaacttatgtttttctatttaaaaaaggagagatacattcagacccagcttttctcaatagacagggagggtgaaatttacttgcctcttcattcagctgtttccatgttaatagccttcctctctcagaggtaaaatcaaggtcatcagcctttaattttgtgctggtctattgaactgaagatgtatcttctgtttcttagatggttcactgacttaggaagagtacatcaaagtttaaagaccttatttgagcaatgaaaaagatgcttctatgcatgtactgctcccagaacttctcatgtgataaccaggaacatgtataaaattgtatgtgtttctacatttttctatgttttggacttccaagtgtaacatccacatgagtggagaaacaagtgttgaagcaaatgttggaaacagggagaataggccagaaatccggtacttgttacccagaagtgctgcctgtttctgttctcaagagcctccatatcatgcagtaagacataaacaatggaacggaatcaccatcttttcctgttgtcctaggttctgttctgtttcagagggactggcatacggtgcatggctaagaaaggacatttaatggggtctcatccagacattgacatgtgatctttgctcatcttgaacttgtgctagtggaaatatatttaatgtatctacataggtatattaattggaacttgatagtgcagataacaggcacatttaataacccaagtgaaattaatttatatacgtaagtgaagtttgaaagcatttcattaatattatatctttagggcttgactttataatcagcctgctcacttaacaaactaaaattcaacataaactacaaatctagtacactttgcattataccatagcagccacaaattaatgagtaataaataatgctgtgagacagtagaaaatgatgctagtaacagaagaaacgtttgcactcactacacccatggctttgctgtacttgacgaatattatcattcaggaaaatgttaagggattttaatagtcagttcctgccgatgatcaataatgacctcattattgcatgtgcttacatttttgtgacatcagaggaaagaaacactgcaaaacccagaattttccaaattaattgctaaaggtcttccaatacaaactcttccaactacactggcacatcatacccttttaactatttctagagctaaagtgaaagcagtagtgtatttaggaaaaacaaaaagaaaaacctagtattcagtttttatgcaaaatcaccaagactttaatgtaaaggggtcctttaaagaaacatactattctcaaagctatattactttatatggccatatgctgggatctcacatataagtgaaattggacttcaatagccataaggagaaatgccactttttcctcccaatccttggactaatgctgtttaactttttttctttttttttttttcctgagacatggtctcattctgttgtccagcctggagtacagtggcacgatctcagctcaccacaacctctgcctcctgagctcaagccatcctactgcctcagcttcctgagtagctgggactacaggtgtgtgccatcacacctggttagtttttgtgtttcatgtagagatggggtattgccacgtttcccaggctggtctcgaactcctgagctcaagtgatctcagcctcataaagtactaggattacaggtgtcagccactgtgcccagcctgagcaatttttgatgcataatttgacatgaaatttcagaaggcttgtaagccaacactccacccccatcctaacaaactaaggtaatcgtttctgcttaaaagtctctgaaaataatactgatgtaagtagagcagcataatacttcctacctaagaaaatatggctgttttcatgttctcttgttaaagaatcattgtgggcagataatgagaagcagagcctaaggaaaagaatggataaattgggaggaagaggagaaaaaataatagactggtctttgaaaggataagggttgaagaattgatgagttatatttgcaagacagttagtgattgattttggtatcttttaaaggcttctctacattatagaaacacattgaactagaagagaaggatgagagccctgataaaaatttaagtattatcctgagccagtccttaaggggagcatgctatgtagccctgctacattgacaatgtatataaaaggatatctttctaagcatccttctaggtatcagttagcgaatgttgttagcaagttaaaaaaatgtctctaggatctgtgtcaggaaatgctcttatttgtattagcctagtcttctctctaagattatgttacttatgagcagaagttgttctatgtactgtatactttcattttcatcttagtttcctttcataagtgttatatcaaagttctgatgattcattgaataattataagtagcaaaattaaaatatttaaaggaaattaaaaagatgagacttttataagactcatattcctacataagactgcaattaattatgagattgggaaaaaacgcaaattattaaaaaataaaaactgaccaggtgcagttgttcatacctctaatcccaacagtctgggaggctgaggtgggtgaatcacttgaggccagaagtttgaggccatcctgggaaacatagcaagaccctgtgtctacaaaacactgataaaaattaactagtgtgatggcctgagcctgtagtcccagctacttggaaggctgaaacaggaggatcgcttgagcccaagacatcaaggctgcagtgagccaagattacactactgcactccagcctgagtgacagagcgagactctgtctcaaaaataaataaataaaataaaaactatcaccaccagcaccaccaaaaaggagatctcataagctttttttaacatttccaaaacaaaggctctctaaacttctttttttctcattctagaaagctaatgatagaattttttttttcccctgaaagcctcagctacattcaccatgtcctgcatttattgttgacagctgttcaagacctacaaggtgaagttgaatattacacacttttttggagttctgctacctcaaacgactctctaaaaatcttgccagatgtaaactctcatgtcattggccacctaaagccaaacacagagtattggatctttatctctgtcttcaatggagtccacagcatcaacagtgcaggacttcatgcaaccacttgcgatgggggtgagtccagattctaaaggatatttgcctcagagatgcgaatgaaattgattgattcttgccggggttgagatcagtcatccctccattataaaatttccggtgtgggagggaagggggtggaggctaaaatgcttaagtgctcactgtcatcagtagcagatcaataagcagtcccattgagacagaagcacaagctctaataatgagatattagcccagtttgttcctgttcttttcagtgtatacttattttagaactgagttcacatcaataaatggtgacatttagaaactttttttttaagatttgccctcagaagcagtacgtttttcaaaacgacagccaaacacagtgagagccctccctgagtcaccagaaatggtaggtggaagttcagccactgagaaaaattgcctgtgactcatttctaagccagttagcaagggggaggaagcaagggaagcaacttgtgaatctgaaatgtgtttggaatggtctttctaatcttttttggctttataaagtctcattataaacattataatatcattacctcccaagcaagtgttccaggtcattagcagagctctttaagtgtggaacccatttccctttgtggtgccaaaggtcggcaccttttgtttataaaatagggtagatcacaaggacaattcttcaactagttaagatgggttcttatgataaaaataggtctttgcatagttatttctgacatgcttgaataattatgcaatttaacgctaagcaagatttttttcttatgttagatttcatcattacctatggtaatcaacattcaaaatcatttacataatgacaatattgcattattgcttcatattgcttgagttacaagctagtaacatcaaatgatttttcacgttccaccagcctcattgtatttgagttttattttttgctcaaggagcaaattttatttccttccctccctcccctgcaccttggaggtatagagtgaaaggatggaaaaaagacaaaaaatagataagtgttagtggtgcagatgggtgaataatttatcatcatatcccactggtcacatagtattgaagattagcactatgctggtggtataaagcattttaccaccaattcttatggtttctaactgagagtataataagccaatttacagaggactacagactgtgataacttcatcagcgaaaagcagataagcgaggaaccctttgctaaacctaaatactaatctgcatttagcttaacatgtgctttttcagagacagctggagtttattcagtttcttcctttaattctagagcctcagggcatgcttcctccagaggttgtcatcatcaacagtacagctgtacgtgtcatctggacatctccttcaaacccaaatggtgttgtcactgagtattctatctatgtaaataataagctctacaagactggaatgaatgtgcctgggtcgtttattctgagagacctgtctcccttcactatctatgacattcaggttagaacattgttttttgatggttaggcttatggatatgttaaataaaacatgccaggctatgtcttcaagtggatatcttctgtcttggttacagattatttctttggtggggaagggaaaagagagaagggaaattgatcagaattaaatctgtgtgctgtaggcaaacatgtgagtctctggagagaagataatgataatatggaaaacgatggtgatgaggatggtgatgaaattctcactggcaaaataaagctaatcatgtattctaaataaatcttgttgagcagcttaccttttcccaggatcttttactgaaatcaaaatcagaatcagtttgtaaatgtggagatgtttttttctcttcccatttctcctatttactaatttaatatctccagagaagttatgaaacttcacttggtgtcaatttcctcttttgtaagcgcaatggactagatgtcttaaaacattctagccacctctagcattctgtgattctgaatgcaacaggaagacatatataaaaaatatagcagacaaaaaatattaaaaggttttatctgaaggtgaaagaaatatatttattcatcactcaaaaaatgttcaatgttctccgcatatgtgagagcaattgtggttaaaattttttgcccttggacttctttgagaatcttatgaagtcagtgtactctgccttagaaaaatatttatgcacttgtatgacaaaatttaacacataatttcagaaagtgcactgatcacttgaagtcaaattcatagacttcttcaggggctactggccttaaaagtagaaaaagtatagggaatactaaggcatataaaacaaggaacttatcttcacggaattggaaatcttgttggagtaccaagccataaaagataacaaggctaaatgtgcaaatgagtgataaaaaaaaatcagagtatttcagaaaccccacatttagagaaagcttgcaatttacaaaattttttaataaactatgctacttctaaaattcataagagcttcgtaagataattttcagaagatattaagcacagaaattttatatgaccacagaaactttttactggttctatccatttaatagtactacctcattcaggtttccatctccttttcctgacatttgaggttaagacatataatcatctggctacaaccaacactttagtctcccctactctgactcatagacctagcttcctaagaaaaccaaataaaaatatctttgaataaagaagaaaggtacattaattatttttctttttttttcatttaaatgtattttattttaagttcctgtatacgtgttcaggacatgtaggtttgttacctaggtaaacgtatgccatggtggtttgctgcacctaacaacccatctaccaggtatttacctgtacatgtattattagctatttattctgatgatctccctcccctgatgcccccccaacaggccccagtgtgtgttgttcccctcgctgtgtccatgtgttctcactgtacagctcctacttataagtgagaacatgtgatgtttgtttttctgttcctgtgttagtttgctgaggataaaatggcttccagctccatctatgtccctgtaaaggacatgatctcattcctttttatggctgcatggtattccatggtgtacatgtaccacattttctttatccagtctataattgatggacgtttgggttgattccatgtcattgctattgttaatagtgctgcaatgaacatatatgtgcttgtatctttataatagaatgatttatatttctttgggtatatacccagtaatgggatggctgggtctaattgtgtttctggtcctaggtctttgaggacccaccacactgtctttcacaatggttgaactaatttacattcccaccaacagtgtaaaagcccttctatttctccacagcttcaccagcatctgttgttacttgacttttcaataatcaccattctgactggcatgaaatggtatctcactgtggttttgatgtgcatttctgtaatgatcagttatgttgagctccaggtgcccaccaccacaccaggttattcttttgtgtatattttcagtagagacagggtttcaccatgttgaccaggctggtatcaaactcctgacctcaggtgatccacctgcctaagcttcccacagtgctgggattacaggtgtgagccactgcacccagccaagtatctactttttgaataatccctttatatgtcccttttacaaagaaataataatttcatttttattcagttttacctctttttaatataaatatagtaagctttatatgtttgttggccgcataaattcttctttggagacgtgtctgttcatgtcctttgcccattttttttgatggggttgttttttcttgcaaatttgtttaagtttcttatagattctagatattaaacctttgtcagatggatagattgcaaaaattttctcccattctgtaggttgcctgttcactctgaggatagtttctgttgctatgcagaagctctttagtttaattagatcccatttgtcaatttttgcttttgttgcaattgtttttgatgtttttgtcatgaaatgtttgcctgtgcctatgtcctgaatggtattgcctgggttttcttctaggatttttatagttttgggttttacatttaagtctttaatccatcttgagttactttttgtataagatgtaaggaagggatccagtttcaattttctgcatatggctagccagtttttccagtaccatttattaaatagggaatcctttccccactgcttgtttttgtcaggtttgtcgaagatcagatagtggtaaatgtgcagtcttatttctgagatctctattccgttccattggtccatgtgtctgtttttgtaccagtaccatgctgttttggttactgtagccttgtagtatagcctaaagtcaggtagtgtgatgcctccacctttgttctttttgcttatgattgtcttggctatacaggctcttttttggttccatatgaactttaaagtagttttttctaattttgtgaagaatgtcattggtagtttaatgggaatatcattgaatctattaattactttgagcaatatggccattttcatgatatttattcttcctatccatgagcatggaatgtttttccatttgtgtcctctctgattttcttaagcagtggtttgttttcattgcacaccatgattcccatagcctacctgagttgtcttagcatggaatatgtggactgatgtttatgttcatgattcttatggtgagtccatgtatgcaggtagaccataggccaaattatgaaatagaaatcatgctccaaataaattagaaatatagctatataaaaaaggctaacacaggaaggtgatggaggatttgccgtattgtcttcttttgaccagtgttcgggaaagctgagttttcaaaggcaccttattcatttgctttaccaagactcgaaacacacaacctagaagtgagaacactgtgtgctgtgcatgcatgtgcagctcagctttctgactctggatcaagagttaacgtttaaaagtgtttaaggcctattctatggaaaaggctttatttataccactactggtttgagtcaggtataaataactcaagccagtaggtataaagcctcctcttctggtagcctgaggagagtggaaacagatgaaaatacaaaagatcaaagtagaatccaataatagaattttgttattagtgcctaagatattcttattactgattactatattttttgtgaagctttttgcagtccaggaatactgtacttgatatagctgttgcatttctggaaatttgaacatcaaatttcagtgattttcattacgatgtcaaaggtgatttagtttcatttaaaataagcatttgattggaatgcctaatactttagaattaaggctctctatgctaaccccatctgtaaaatagctattgattttaaagcacataacacactcaagtatctacttttttttttttttttttttttttttttttttgagacagagtctcactcttctcacccaggttggagtgcattggcacgatctcggctcactgcaacctctgcctcctggaatcaagagattctcgtgcctcagcctcccaagtacctaggattccaggtgcccaccaccacaccaggttattcttttgtgtgtattttcagtagagacagggtttcaccatgttgaccaggctggtatcaaactcctgacctcaggtgatccgcctgcctaagcttcccacagtgctggaattacaggtgtaagccactgcacctagccaagtatctactttttgaataatccctttatatgtcccttttacaaagaaataataatttcatttttattcagttttacctctttttagtataaatacagtaagctttatatttgtgtttcattcacatgttatacaatatcgttttagcactagaaataggtcccaaaatggagactgggaatgttaacattagtaagaataaaaacatattggcacatttctctaacatttgaggttaaaacatatataatcatctggctaccagcagtagtcattggtcattttcctttgaccaatgaatcaaaagaaatgttttctggagaaacatttgaatatacctaagtagtttagagcttaaagttatgtttaacatttagatgagaagccagtagggtacagtggagaacaactcagatatcccaaatcttaccagcttgacaatattccctggcttctctgcaaatttgtttaaatggagttatgaggaatcaatacgattatttgtgcatatatccattataatatttggcacatattagatacataataaattcagttgaattgattctgggttatctcattatgtatcacagaatcaaatttttccaatatgtataaagttcattttcattaattatattacagcattatattttaagttcatctgcctttatttcagatttaattggacatgctcagaatgtaggcccttgatagtgtttaaatatccactattaatacctcaaaagactatatggcatcaataagtaacacaactcatacagcattatgaacatatgcctcaactaacatttaggtaccctatgaataaaatagcatatctagtaaatacaagaatcccatttgcctttcctcaaccaccaaaggaacagagaactgtttcacataaaagctcggaattaatgtttaagattcatcagtacctagcttgccttctctatttatatattagatgcttaaagtaaattagcactgtaaaaagtacagtttctctttggtttatcctttaattgagagcagaatgatatcgctttgcagatgttcccaatcttttgcatattcatttctctctcctccctcttggttaacgtgttccttttgtgtgactaatgcttgatgaaccccatttctaatcttcagttattccaccctcctcggtttttattcagattaggtggcagaattaaagggatgaatgatgattttctgctgtgattaaggtaaaaatacaattgcatctggaacaaatggatataaaatacctcagccatattggaaggcttctctaggcctcatttttcctccattagacattagcatttaggctatttgttttacagtgtcaagacttccagaagataccatcattacactacttagttatagatttagagaacagtgagcagtgataacctgttatgcttgcaaactgtcacttgggcatcttccattccttgactatgctcttcagtagattaatgtatctttctctttgtgaatagttgcaaccagagagtaaacatcatcattcccattactaaatcaattatcttgatcccaattccgtaccttcctctgagctcattcctttggagtcagttaacatcaaaaatgaatattgattaaacctcaagaggctatagagaaatacaagagattcatgtgaaatgagggaaggtgggattcagactattgttagtaagtatttcaaaaatggttgcatttattttttctaaactaatgtttgcaggttgaagtctgcacaatatatgcctgcgtgaaaagcaatggaacccaaattaccactgtggaagacactccaagtgatataccaacacccacaattcgtggcatcacttcaaggtacaaaattttgtgtcagttaaatctaaggaactctgatcagaagaaatgaaaataaaaatcaaaggtatcctctcagccatgacaatctcatttaatgggttattataagtatgtgtgtaaatcaaatttttgatattatttcacagatattaatcttcactggacatccaatggcatttaatctttaatttccctgattgcccagcctcagatttcttatttagtaacctgtaagcaaatacttgaaatacatgtctccttatttgaatgtgtcctttagtgaatccttttgcggagcataatacaagcttaattgtaatgactaccttctaacttaatctttttgaaaaaaaattgatttatatacatcagagtgccctaaagctagaaatctgtaaaattagtagggcagataatgtttagataagcattaccaattttgtcagcttcttggtagaatcactttatttttctttattcttttgttgctgagaaatgaccatagtttgaaagcgagtctctttataattcataattagtaacaacaacaataataataatatttggtattgtttccaaagctgaaaataagatggtaaattgttcatccgtttgtatcaagttgaggctgggaaaagaaatcttagtgctttcacattatactttttgcttaagccaaatgaatcacccttctcttacatgtgcaaacaacacacacacacacacagacacatacacacactgaaataataagtctattattaatgtttcaattctgaaggatttctctatgacatgttgaaatttctggatcttaaatcagttcaaaaaattagtactggttttggcaaccaatggttaaaataattagaaaaattcaactaacctgactgttagctgttcgtggcaataatcatatcttgtctgcttgagtatatcttctatcaaacacatgatagatactgatctaatttttggcatactaattagtttataatccccccagcagatatcccccaacctattcacagtattatctactatgcagggaggaaatagtcatattaaatgggcgttagagacctttattctttagcaaacacatctgtggctataataatatagaaggcaaggtggggcgtggtggctcacgcctgtaatcccagcactttgggaggccgaggcgggcggatcacaagctcaggagatcgagaccatcctggctaacatggtgaaaccctgtctctactaaaaatacaaaaaattagcagggcgtggtggggggcacctgtagtcccagctactcgggaggctgaggcaggagcatggcgtgaacctgggaggcggaacttggagtgagccgagatcacgccactgcactccagcctgggcgacagagtgatactctgtctcaaaaaaaaatatatatatatatatatatatattatatatatatatataatatatattatatatatataatatatattatatatataatatatattatatatatatatataatatatatacacacacacatagaaggcaaaagtaatacaaaagagcataagacatgattctaaatttgcaaagttccagtccactggggaagatactcccctaaataaatgtttatagaacaatgtaaaaaacactataataagaggtttagatgtgcaagaacataaagagaaaaatagcaaactttacccagaattatcagtgaaggcatcatggaagatgtgacctttgacttcagtcttgaaaagctcaaggaagaattatagttaggtgggtggatgttttcaaattcttgtctgctggcatccccatgactcaagcccatgtgaatgacgtaacagaatatgcctcatagtacatatttatttataactaaaaataacgtctaagctttataagaaatggaacaaatgtgactgtgtctctaggttttttttcctttaagaagattattgcacataataacagaggacaaatatttttagttgctattaaaaattgcttgtatccaaatacattaaattgatgacagaaacattaaaaagagtattatacaacaagaacaaggaaagtgagagaggagacaacaacagaaaagagattgcaacacaattttgtaagcaatatttgtcagaaagaagcaaatgatttaatacagtggagaaatttacaaccaaaatattggttgacaaaagacaataatgacaggaaacaaactgttttttccacagagaactggagaggctgagcacttagaagttttaaggatgtaaagaggaggagagagggtagggtttaaagctgaaatcatggggtgagacacaactgttaacaaataagtgtttggaatcccaggtctcttgcatctttgctgtgcatccaggggtctatttctcttcctccacatgacaaagtccaccgaccaggagattagacatttattctctggagaaactgagggctactaggcagaggggagctgagatgagacacagaagtaaaaacagtgataaagtgagactacaacctgaatggtgggctttttggctaagtttcccagttctgccctcaaaagcaagtagacaagtcataaacacctccagataggaaactgaacatagttttctagaaaaaaaagaatgatctcaaaaaaaatacctccagataatagcatatagggatccctaacagtaaaaacaacttgtcctctggtcacccagtagggaagtatgccaatcaacaaggctcacctaactataaagcttttagtcagctttttttttttttttttttttttttggtgcatcactcttaaagataaaaaggggaccaaaataaacaaaagacatgatacaatagattcagagataatgcaggtgaggaaaaaaaattatagcctcagacagataaaagaaaattctctaaccataaaacaaaaccagcatacttaaaaaaataaataaataaccaacgaggagaaaacttcatggaaattaaaagggtgaaaagctgaattgaaacttttgaagaaagttcaagggaatgtctctgaaaatgcaatgaaacacaaagatttaaaagagagagagacaaagaaaaaacaatagagagtatccaggaagtctaatatttgaataataagagcttcaaaagagaatcaaaggaaaagagggagaaaatttaaaaaaaaaaaagacaagaaagtatcccagaaccaatgtactactgtgcagatcaaaagattccctggataccaacaatatgactaaaaagtgattacatataaagggatattatcaggaaattgcagagtaccatgtttaaaaagcacatccaaaaagctgccaggaagaacagacactaccacaatcaggatgtgaagcagcatcatgatgtcggtctccattattgctaacccctcttctacccttcctaaaactaagcaaacactgccatgttttgttatgtataattctgccttttccatattgtcatgtaaatggatcacataatatgtagccattcaaatggcttcttttagttagcataatgcatttaagatttgtccatcttattatatacatactagcagttgtatacatactagtagttgtcagtttttgttgctgagtaagattccattatatgaaagttctacagtttgtgcacagtttggataattttcagttctccgtgaccacgattaaagttgctgtaaaacatctatatacaggtttttgtgtgaagatatattttcatttcatgtgggtaaatacccaggagttggattgctgagtcataaactgccagactgatttacaaagtgactgtaacatctttcattcctactagcattgtatgagagttcaagttgctctacatttttgctagaacatgagatactatgaggtgttttcctcttattttttaaatagtcattttaatagatgtttgtggtgtgttattatggtcttaaattacattttccctaatgactaatgatactgataagctttgcaattgctttttgcatgcactttggcatttgtttactctgggaaatggtatctccaaatcttttgcaaatttcttaattagattctttgttttcttattttttgagttttgaaaattttttaaatatattttggatttgagtttttgtcacatatgtgatttacagatatttcttctctaccttatgatttgttttcaattatcttatttgtgtgtttttaagagaaagagttttaactttccaagagagttagatttgttactttttccttgacagtttgtgcatctggtattttatctaagaactttttgcctgagttaaggtcacagagactttctcttgtctatttcctagaacatttgtatgtttacatgttgaatttatgtctatgattggttttgtgttaatttttgtatacactgaggcatgagtcaaggttaattttttttggcatgtaagtatttaatagtatcaacaaaatttttggaaagattatcttttctttattgaatatttttagatttttgtcaaaaatcaatttaaacacgttttgtaggccatttttggactctcttttatgttcaatttatcaatatgtatatctataccaatatcgcacaatcttgattactacagctctatagtaagctgtcaaatcacattgtatgagtcctccaactttgacctttataaaaatcattttggcctttctcactactttgcctgtccatataaatttcagaaacaggtcattgatatctacaaaacatgtgattttgattagaactgcattgaatttgtggatcaattggtagagaattgacatcttaacaatatcaaatgttctgattcaagaacacactcttgctcatttatttgcatcttctttcctttattttatcagtgttttatataatccagtatgcaaatactgcacatattttattaagtttatacctaattacttatttggggggtgctattattattgtttctttaaaacaaattcaaatccaattgttgctagtgtgtagaaacacaattaattttggaatagtgagcttacatccagcaaacttgctaaactccttgtaagtcttaagagcttttttgtaattccctagtctatatagatcttctacaaagagaaactgtttatttttttcatttccaatcagtatgtcttttatttctttttcctgccttattgcactggatagtttaataacgtgataagagcatatccttgacttgttcccaatctttgaaagaaaactttcagtcttttacccttagatgtgatgttacgtatgaaatttttggccatgccttttatcacgttgaagaacttactttttatttttaatttgctgacaattttcattataaatggacatggaaatttgtcacatgcttttttgacattttaaatttgtactatgatcgattatatttactgattttaaattattgaactagtttgtattcgctggataaccagaacttcgttgtgacatattttcttcttcatatattgggggatgcaatatactattatcttatagaaaatgttcatctgtgttcataaaatatattggactgtgtttgattttcttgtaatacctttgcctggattgggtatcatggtaatttctggtctcatactaacttgggaagcatttccttcttttctattttgtggaagagattgtacaaaagtgttattatttcttaaatcttggtaaaattcaccagtgaaacccatatttgcctggagtttttctttgatggaaggttttttaacttggaattcaattcccttaataatgtatgatatttggcaatttattctccagtgagtttagtcatcttgtgggtgcagaaaataggttaatttaatcaaatttgtcaaatttattagcaggaagttgtttgtagtatgtttgtactacaaacaacaatttgttgcaattgattttattctttcatttctgatattggtagtaagtgcccccgtttttctgttcagcctagagttttatcaattttgtagatcttttcaaagaaccatttttggctttatttattttctatatcatctacattgttttctattttccatttcagtgatttctgctctctattgttttcttccctcttgccttgctattgcttctctagtttcttaaagatgaaaactttcattattgatttgagacctttcttcttttctctcagtcctgcttcggtatgaagctcacaaattttgaaatgttgcattgcacttcatttattcaaaatatattttaatttctcttgagacttctttaacccatggattatttacaagggtattgtttaatttccaagtatttggggatttttcagataagtttctatctgagtttccagtttaattctattatgatctaagaacataattttagaattccaattcttttaaattagttacagttttttcagggcccagaatatgatctatcttagtgaatggatgtgcacttgaggagaaggtacagtctgttgttgtcagatagagtgttttgtaaatgtcaattagatcaagttgagtgataatggtgttcagatcatctatatacttactgattttctgcctgcttgttttatcagttattgtgagaatggtgttgaagtctccaaatgtcattgtggctttatctatttcttcttcagatctattagtctttccttcatgtactttgatgttttattattaagtgcatacatgtttaggattgttaatgtcttgataaactggctcttgtatcattatgtgataagcccttttacttcctgataatttccttgttcttaagtttattttgtctaatattaatatagccactccagctttcaattgcttagtgtaattctgggtgatttttcgattgattccttcacattttgaatattacgttataaaaatctgactcctgttaaaatcctttgaagaaagttagagttcttatttacttttttcagcaggttaccaactggttagcttcagactccaaattctgttttcctttgccagtgactacagtcagttcctattttttcataaagtagcataacaaagctataaactttgctttactactctgtgtctgcacaatggctaatttgggatttggctgtagaattatgtaatagttctgatctcaaaatcttcgctgtgctgcttgcataggctatgcatgtgaggcaaccataaatgtgcagcttggagttgagtcaggacttgcgttcgttcattcataaaattagcttctagctttcttctctctgaaatgtcccccatctttccagctcctttggacttccttccctggatttttggctagaatgatatgatttcttttgaaatgtttgcctcccagcctgcctccaaatttgcataactggagttgttcttaggcaatgaggtaagaggaattcgagaaaaaaaaataacaaggacttcccccacattctttggactatagaggccccatttcctgatttctctggacagaaagatttttccccccgttggggctttagattccaatttggccacagctgccgcagtgcagctccttggctctgatcatcctcggagcagggcccagcagaaagaagacaaaacaaaacaaaaatgggggttttccctatactctctggcttgcaaggcattttgttctagatactctagccggaaaaaatttactttctctaggattttgcttccctagttcacagtttcacactgatactgcccttgggttaaagatgggaagtaaaggagggggaaaaaaaatgggaaactcaccctgtaacattcattcttaaagttttgtctcccctcctgatcagccttattgttagcttttcagagtcctcaggtagttactttatataatttttgcagatactgagttgtaatcagtgggagagataagctgtaatgggcttattccatattggcctgcatgggaagtccccctccaccacagttttctttcttccaatgcctttggcaactttccttttcccccccagtcagaagcctagcaaaaacttgatagaaatcattcataaccaaatattggcatgtaaaatctttcctttcttaaaatgatccatagtagcagagtaacattttccaaaggcaagactctaatgagcaactataggctgccaagccattaatcaaaattataccaacaccaaagcagttagccttgtgtgtgtatggtattgtttgtgtaatttcattatacttctggcaatgtatacttgttagttatgtttctattttggttttaaaaaatctttcatattagcaacatgcaaaatgaaatgtgaaatccttccagaaaaacatcagcagacggggtctacttctctagcatttaaaataatttggtttctaagaagccatacatttcttagattctttgtttatttttggtgaaattcagaagtcagtaaaatttaactcatatatttcaataacatacagatagcataccagcctgtttgattatatgcgtgcagtgtaccaactcatctttgtctttggccttaacttatgccttgtttttgactacatcttcagcagtacaagcccttatgcatgtttttcctcttatatataaaccaaagattccatagcacacaaataatatagaagaatcaaatggacccttctagttttataagctgctgcttcagagacaagccctgtttctacattgcattttccatacttctcatattatcatcagctccttctatatcccaaaagaatactaactactgatcgataacccggacatgtctggccatggcctacatgtgccctgggtagttcatttatttgtcttggtggatttgctagagtggaatttaatcaatagctaattcattaattctggtcctcgagaatgtagagactgacctggatgaagataacgggctgggtctggctttgatagaaatatgacaaacactgcagctgacagcttcactaggtactgtgctatgaagtttagttatttattccccataaatggagacactaagaaaataacacaaacaagaaagatgttttattacattactgttagtattccaaaatgcatcatttccaggcatgaggctcaagggaaagtagagaaagaactcagatcatgtcttttaatgtctttaattggaaccatggcagttttttcacatccaaatcagtttggggatgtgttattgataaggagtgtgaggtataaagtcttcgtagcactcacaaataattgttttaagatttgcttctagatgctgaatgagatcaatgatattcttatacacaaactttgcagaaatctttctgataacagcataggttagatgtctctaaatgaatgctaaaccactatcgttattaatgaatatctatatatttttttcttttttgttgttgttgttgagacaggatctcgttctgtcacccaagctggagtgcagctcactgcagccttgaccttccaggctcaagcaatacttcctcagcctcctgagtagctgggacaataggcatatgccaccacacccagctaatacatttttaaaattattttgtagagttggggtctcactgtgtcgcccaggctggtctttcgaactcctgggctcaagtcatcctcccgccttggcctcctaaattgctggtattacagatgtgacccacacagcacccggcatccccctatatttttaaattacttaatgtggggttaagtatggttcaagaggtcagagcttgtggagaaagaggattctccttttttcctcaccaaattttatgagacatgctatgatatactttttatgctatgacattagatatcagggaatctcttctatccttgattttttctgcctaacttttctcagtgaatgatagcttcaactgaagtaatgattttacagttttgtaaaattaaaagaaaaaattaatattttacatttaatttaattatttaacattacaagaaaaaattaaggccacatttctgtttgtttgctttaatagggagagtgttgggctgaaggatacagaatgtcaaatcacttgttttcacctgtataccaaacttgcttaccaatatgggcaattgtagactatttttaatatggactaaaactgtctgcttaaacctttaaaggatatgggtagaaccttgaaagagagaatttggactacactaagtgcaattcgtacagatccaatcaatagccttatggtcaccatggcttttaggaaatattactcatttgatggccatgagttctgattatcacattctgtttaaggagaccttaatagaatagtgtcagaatatagaatgtaaacagaaagacagaatatatagaaaagagaatattgggcttattattatggctctgctatcactattttcatttccttacctccctcttcttcccaaactcctcctaacttctttacctcttgtagctcccatagaaacagctcggtcgctgaagtagcctttgagtgcctttcagcaaaatccagttcttcctcctaattcactttagccctcaactgccactttgtccctggttctctaaacattcattgttttgttttgtttttattggttccattaaaaacccacttatgcattctgggtgtcctcaggaaaaagactccctaccttgctcaggtagttcagtcttgcaattttaagccatactgatgtctcaaagatctctggccctgttttcttcctaaactctaatcccacatacccacttgcctattgattttatgtcatgatattcacccatcacttccataaccatgagattcacaagttaattcttatctaactcatcatcttttccaacactcacttctgcaaatgtaccaccatcctgcatattatcgaggacatatatctttgaagtatttttaatcccctaagtttattaaacactgattttagtacattttctgttggagcatcttctcatatatgttactcttctccatttccaccactaccaccctggttcatgttttcatcgtttaagtttatataaccattttatggagctgtcttaatccaattagatacaaagagaaaaaaaaatcctttacttttcacctgctacttactgccttaaacacactgttttggctatccttccctcaattctcaaataccccacaggaacatcttatgggtttccaattatttttagttatgagtctcactttgataattaagattcatgatcaagtattaaaaagtccattccatcaccatcaaaatattagcctcgcatctagttcaaagattctatcatttctaaagctcaggcctaattgtagcttgctcttttcttccctcttactctttctttcctattccattttatccaaatatgttccctttcaattttattacttcactgccatcactgtttgacaatcacagctctccattggcaagtgatgctttcttgggcaattgtatgtttttcttgagaggtcctcatgagaatctttgaatagccaaattccctcacacgagtgttgccctttatagctgatcacttgtggtgccaaaagagcagaacattccaaagactcttcctgctggagtctcctcatgccagaaggccactgtcctgggccatgtaccttcaagttagctcaaacctagccatcttgcaaggcatccacttggctcttgagaaactcatccatctatgccatgctatagatcaatattgtggtattctaggcttaacctttcattgcagaactgctctggccaatctctggccactagaattctctaactgagaagtaagctttatttcctatgctcatacagactgccaaatttaagagttccctgtcaagctgtcccaagatctcttcaccacattttcctccaaggacaaaaggagggaaatgtgtgttcctttttattaaaagaacatgggttttgcattttgactttttacctactacaatttataataaacatctcagtaggataattaaatattcagtgacttgacttgaaagcaaagaattaaatttgtcatattacatttatttcatctttgttaaaagtgttctgatcatttttgataaccatgatctggaataatattgaagaacttgagtgttacataaatgattgacaaaaatgaccaaatcgattagaaaaaaagcctgtgtaaacataaccagataatctagagctatttaatccataacaatttaggttaatatcttagagtgtatgaagatttcttttctctggtcaaacaaaaatgttttgaaaaaattggggaaaaatattagaatgaaatgttaaagaatagtaatgtgaacctgtcttcataaaaatttgatctgacttgtatcattttgatattcacctgtgtaaaggtaagtgatatcaaattattttccctacactcctttgtatcttcaatggtattttgtacttcaagggacaactggaagtgatgagatctggggagggtgaaatgcatctgtaatcctaactagttgggaggctgagtcagaattgcttgaggccaggatttgagtccagcctgagcaacatagcaagatcccatctctaaaaataaataaagaagaaagtgatgacaactgtgggggtggcacaatagtatgtagtagtaacagtaataaaatagtaattctgctgacaatatgacataattaaaaagaaataactacaactagaatgtctgaacacttgatgaattcatgtaccaaaatatgtgtaaagaacttccagttccaaaatgatgacatagaagcaagctggcttcactcctctccacagaaaacagaaacaaatgtacagaactgagattatcacagcaatatcccagaactcaaatatgaggacaagacagttcccaaagtcacagagaagtgaaaatctccgagcagatggtaagaaaattggactttcatatccacaatgcccatctccccaatatattcagcaccacgcttgtggaaaatattttcctgacccttgatttctgcactggaaaagtgcgattgaagtggacagtttcccgaccgtcttaggttacctggcaggagacctttacctgcctcaacccacaggaagcatcaggagtgcccgaagggctctatctctgtgaggacatccagagacaatgtggggagatgggactaccatcaccagccctggaaattctgctctgtaactcagtaaaaggagatgccaaatcagagtggctgttcagcagcaccacactgtagtagttttgctccacaggtttcctgggcaccaatcctcagccagcctcctcacactaccaggatatcccctttggaacctcccctatttgggaaaggtggtattctgatagtttactggagacaaggcaaacctggacctgaggcaccatctagtgccaaaaaggaggcagtgacccagtgaattaaaaaaaatgaaagaaaatgaacagaaaaattacaaagaatctctatgcaaacatacctaagaaaaaccaaagcaagccagagaagactgcaataaataactaatccttcaatgcaaagacatagacatatatccataagaaatggagagaagagtaatatatgagaggatgctccaaaagaaaatatactaaagttgctgtttaataaattcagggaattaaaaataattcaaagatacatatccttgataatatgcaggacggtggtgtgtttgcagacatacaacttctttaaacagggaagtaggatcttctcaagctgacaaaagcaaggaaacagtgagtgaccctaacaagatggtgataggtgaactctatgaccaagaattcaaacagttttaaggaaactcatgatcaccaagatagtacataagataaattcagacatttctcaacagatttaacaaagagattaaaatggttcaagaaattaaaaaagaaatcttggatctgagaaatacatctgctgaagtgaaaaattcattagaggctctcaatagcaaactagatcagaggaaagcatcaacaaacttgagacaggctatttgaaaatacagagaggtggggataaaagaatgaaaacaagtgaagatcacctacaaggtatatagaaaactacctgaaaagacaaaatctaggaattattggtgttcaagaggaaggtaaacaagagcaagaggtagaaagctttttaaaagaaagattaacagaaaactttgtaaaatgtaagaaacagagaaatatccagatatagaaaggtcagagaagaccagatttgattaaaataagattattccaaggcatataacaatcaaattcttaaaggtcagtgacaaagagaggatcctaaaagcagcaagagaaaagaagcaaataacatatttaaaagcttcagtttgtttggcaacagtctactcaacagaaaccatacaagctaggaggaagtgggatgacattttcaaagtgctgaaataaaaaaacaaatgccatataaaagtactgcatacaataaagctatccttcaaatatgaaagagaaatgaagtccttcccagataaaaagctgaagtaatttaccactatgagacccatcttataagaaatactaaagagagttcttcaaactgcaagacataaaaaactaatgcacagaaagaaaacatttgaaagtaaacccactgataaattaagtacacagacaaacccagaatactctaatactgtaattgcagcatgcaatccactcatcacttcagtatgaagcccaaaagacaaatttatcaaaaacaatagtaggtacagcaacgtgttaagagatagacaacataaaaatatacaaattgagacgacataaagtcaaaatatggagaaatacagttaaattttagagttttttcattgtttctttgtttttggcaaccaagtacaataaccatatgatcatttcaatagatgctgaaaaagcatttgataaaattcaatatggctttattataaagtccctcaagaaactggatatagaaggtgcatacatcaaaataaaagccatgtatgacaaacctatggctaacattgtactgaactgggaaaaaatgaaagtctttcctggaagaactggaacaagacaaggatacccacttacacttttattcaacacaatactggaaatcctggtgaggcaatttgtcaagagaagaaataaagggcatccaaatcggaaagggataagtcaaattagccttgttaacagatgacatgctcttataattagaaaacctaaagactccaccaaaaaacctgttagaactgatgaacaaatttagtaaagttgcagaatacaaactcaatgtacagaaatcaatagcagttatatacaccaacagcaagcaatctgaaaagaaatcaagaaagtggtcccattaacaatagctacaaagaatataaaatacctaggaatcaatttaactaaaggagtaaaatatctatacaagtaaaactataaaatgctgatgaaagaaattgagtaagatacaaataaatggaaagatattccatgctcttggattagaagaattaatattattaaaatgacaattttacccaaagtaatttacagattcaatgtaatacatatcaaaagaccaattacattcttcacagaaatagaaaagtatttctaaaatttatatggaaccacaaaacacccagaatagctgaagcaatctgagtaaaaaaaagacaaagctggaggcattacactaccttacttcaaaatatagcacaaacctaaagaaaccaaatcaacatggtattggcataaaaacaaacacataaaccaatggaatagaatagagaacccagatataaatccatgcatttacagacaactcatttttaacaaaggaaccaagaacttgcaatgaggaaacagtctttttaataaatggcactgggaaaactagatatccatatgcagaagaatgatagaagagacagaagagatagacccctatctcttaccgcattcaagaatcaactcaaaatggattaaatacttaagtctgagacctgaaactgtaaaaccaatagaagaaagcattggggagatgctcccagacatgatctaggcaaaggcatttgtgtaagatctcaaaaacactggcaagagaagcaaaaacagaaaaatgggattacatcaggctaaaaagcttctgcacaacaaaggaaacaatcaacaaagtgaatagacatgccatagaatgggagaaaatacttgcaaactgtctatctgacaatgaattaataactgggatatataaatagcttaaacaactcaaaagcaaaaaacaaaaacaaaacatctgattaaaaatgggaaaatgatctgaataggcatttatattgcctattgcctattcagaagacatacaaatggccaacaggtatatgaaaaaatgttcatcatcactaaagagatgagaattgcaactcaaaaccataatgaaatattatgtcacccagataaaatggctttgataaaataaaaaagcaggaaataatggatgctggtgaagatgtggagaaaggggaactctatttacactgttggtgggaatgtaaatttgtacagccactatagaatattgtatgggggttcctcatgaaactaaaaattgaactactgtataatgtagcaattcactactgggtgtatatccaaaagaaaggaaaacaatatattgaaaagacacctgtactcccatgtttattgcagtgctgttcacagtagccaaaatatgaaatcaacctaagtgcccatcatgaatgaatggataaagaaaatgtggtacatatacacaatggactcttattcagccataaaaaagacttaactcctattatttacagcaacatggatggaactggaggtcattatgttaagtaaaataagtcaggcatagaaagacaaacattgcatgttctctttcatatgtgggagataaaaaagtgaacctcatgaaggtagagagtagattggtgattaccagaggcctgagagggtcatggggagagggagaggaagaatagattgattaatggatataaatttacagtttcaatgaagagataagacctagtatttgatagatcagtaaggtgatttatagtttacaatatcttttacatatttcacaataggtagaagggaataatttaaatgttgttagcataaagaaaagacaactatttaaggtgatggatatgccagttacattgatttgctctttacaaattatatgaatgtattaaattctcacatggaccctgaaatatgtacatctattatgtattgattaaaatatatttttttaaactccaggcttccccaagattgtaatccacctgtaatttaactgactgctagtaaagcctgttactttcagaggaaaacaattcaacctagagactttgcaaagtataatccacaatgttgtgtgtatgtgggctgtgtgtgtgtgtgaaggaatgagaaaatgtaacccaaacatttgagagagaaaaaaatgtgtgtagacatggtgacttttatcagaagttgtattaaggtatcttaaatttcagttcctattactttaaaatctaaaaaaaactataacagttatttcatgaacaaatctaccaaaaaaaattcattcaaatatttgcaatctgtttatgtttatgcatgagtgcccaaaagtatcttcagctctttttctccaatatttaacatttattcctgggattgaagaatgttccttctattttactcttaaacatcaaagcaatgaaactattaatcccgctaataatgatgcatatttctcaaagatgcctttcattttcagatcagcaaccaaaggagtttcaattgtctctccagttggctctaatgagagatgtacagatgttaaacccaatactcttcttaatcattttccttcgtgtacttgattaaatcctcaaaagcaaactgttcatgttcttgccgaaaatataggcggtctcacttaacagttatgttgcacaagaaagggaagttataatggcatggaacgtgctctacgtggtattttctagactttactagttcacgagcttttgtggataagtcaaactcttgaatgtcacttaaatgtaatcttttctgtagttgattatgcagagaatacaaaaggtatctgcagaatgtggaattaattttgaaagtttgataaaaacttcagaataatagctgtggctgtacaagtcatctatgaaactgttctctcataggtgacattaatttcctatctacagagttttattactgaatgtgttatgtttgtacccccacaaaactgaaataatagttttctttttttagcagtctatgaaaatgttgaggtttatcttgactgccgctttttaacataaatatttgggcttcattgaattcctaatatgtgatgtcacttggaattctgatagggtccagtaatttggcctgcaaagacatattttaccttaaaatgaaagggatagttgaaatgttattttacacgatagcaaaaaagcatccaacataagttgtgagatttttattgcttaacttttgaaatagaaggacaaggttcttatgtgcttgctttattccaaagtatatatgggaatgctaatgctttatatgtaaaatgtacgctacacatatttgtgattagttaatttttatggctagaaattctagaatcataaaaaagaactaatcttgaatgtcagagcttcacctatttttttaaaaacaatgagaacaaaaaaatcattataatttttatatttaccttgtgtttcacaaaaaggaggttttctttgctgtgctacactgcaagaatatgtcatgttcaaatctctggggctttattaaaaactttaactactgtcttcttatagagattattaagcaaatactaaagatagcatagatgtgtggtctaggcagtatttttctggcaagtagacctaagtgcagaatttaagttctgtaacattaacctgagactaaatcattttattcagggttgtctcctctgtgaacagctttatgttatgacctcatttgctacagcaaatgaaatattaatagatcattgaaaatgcagtaaagttttgatcagatgttataccttcattgtataccaaaccctgcctctcataaaaactttctacttgggtttaaattgaaattatcactcaattttttaaaatcaaacattttctttaagaacatgacaatgtaaacatatttcttacgggaatctttaagttctatatttttcaccaaaaatcatttcagaccatgctagttaaagagttattgaaaaaaaaaagaatctatttagatgagtcaaaaaattaagcaaagtatgttttaaataagttagtgactataaaatttctcaatttgggcatttattttgactgcaagtaacaaaacacctgacaaaagagacttaagtaaatagctctagatatatagttgactcttgaacaatgcaagggttaggactgctgatccccacccagtcgaaaatctgcatataacttttgactgtcccaaaatttaactactaatagcctactgttgaccagaagccttaatgataacataaaaaactgattaaaacatagtttgcatatatatttatactatattcttaccataagtaagctaaagaaaagaaaatctcattaagaaaatcataaggaagagaaaatatatttactattcattaagtggaagtggatcatcataaaagtattcatcctcattatcattatattgagtaagctaagtaggagaagaaagaggaaaggttggccttgctgtctcataagtggcagaggtggaagaaaatctacatgtaagtggatctgcacagttcaaatttattttgttcaagagtccgctgtggatagttgttggcattggtgaaccaatgccaaatataatggcggcatctttgtgattgttttggccttttcaaataactgaaagatgattgctgaagttgtagacatcatgtttagcggaaagaaagagaaaaggagaaggtggcagctctttcaagaaagctaaaatttcctaggaacctccataggagtcccatcatggtgttcccgtggcatctctgagcagttatgtttcatatcacaactcctaggtaaagtaaggcaaaggagaagcaggttagaagtaggcattaagttgccacatgttctaattgtcaccttgtttaccaagtcatgtatgtcttatctttgcttaccaaacaaaatgctctgattttcttgattagccatagtgacacttgcttcttgtctttgaaactgaaagtaataaaccacctcacgccatgtgttattcttccaaaagctaacataattttgattgatttgaaaatatatgatttcatatataaacatatataattatatatatatattagtatctattgctgccactttttacttaagactgatagcatcaatgttaaatagtgtcttttcagaagtattgattattctctctgttgcagatctcttcaaattgattgggtgtctccacggaagccaaatggcatcattcttggatatgatctcctatggaaaacatggtatccatgcgctaaaactcaaaagttagtgcaggatcagagtgatgagctctgcaaggcagtgaggtgtcaaaaacctgaatctatctgtggacacatttgctattcttctgaagctaaggtaagtcttttctaactaatcagtgaaccatgtttttctcactcaagactccaagtgaaattattagcttctcacaccatgatgtattatgatcaatatttccactactctatgaagaagactccacggaaaagaaaggatgcttacaaaaatcactatcaccctcatgagcactttagccttcccattttttattatcttcacaagaaatataaacttattagaatagggtacatcccaaattttatttgattgagtgacttaaaattttctttacaacagatcttttcagctacaaataggtgtttgtttatatggcactgatgagtaactgtgaggaggacattttatgatttgtcagaaatattttagcattatagtcatttgtagattaatgttcatattagatgcggtttagaaatcagatcaataatacagccagacagaggagtttgtaaatgacttttattgacaaacaacacaaaatccttagtttgaaggtagaattttatataatgaaataatgttcctatttggcaacaacagcatcacacattcaatggctaaagctactactaaatttataagatttactgcaaaagaacaccataattaagaaagtgagttactgaagcaatatggatcaaaatacaaattattatggctgacacaaatttagcaggagttatcatctaagaaatgcataaagccagcagttactaactgtgcattttttgatacttagactctaaaattatcattatgcctacatttgacatcattttatgccattaagtatgcacatatttaaatacacacatctgatgaacatatttgtataaaattaaatttgggatttctgagaagaaaaatactaaaataaatttgcccattaaacatatcctccacttaagaaaaacttgggaaaatgttggcaaaatacggaattcacttctcaatttttttctttgcttctattattttaatatttattatctgttacgaagtggacaaagagagaatagttgtataggcatacgaataaatgatttaaagtttgtggagtgcagaaaacaatgtgttccatcaaagtaaaaactgattctggccagaaactgtcatagtagtttaggtgtgtataatggatttgataagtttcaaccctataactttagtggcaaaatcaaagctaagtagagtaaaactagtaaagataatgtttccatttaagtttattctaaaagatcaaaaggtggatgttcttaaaatgttcatattaaattagaatatacctgagatagggtgaagaaaaagtaatgggatgaagaaaaatattaataaagtattaacagaataatatttacctatgtttaggctaaattatttataaaattactcctacctttctttatgctgtgatttcagaaaccgctttttgtaacttttaaaaatttactgaagctttgtaccaaataagtgactggttggtgtaacattcctaaattcagtgaatgacaaagaaccggttagtttaattttaaatcaatttaaaaatgatttagacaaatctactctacaaaaaaaaaaaaatcatacgggtcaccttttatagaaaataaatgtaaattgatgaatagggaagcaaaagttaggctttagaaaacaggcgtgtgcaaatctcaccacatagtcttgaaaagaaacatcacatttggttattcttataatgcaaatgtcataccttattacactaaaacgagacacactatttaatgatgccttaaacaaagtcttatttttattgttgagcttaaagaggcaacacaggtattgcggtaaaagagaataaaggatgtcagttaaatttcaaaaaaaaaattgtaaagttcagtttgggactaggtactaatacacatttcctagcatgaaagattggagagaagtagaaaagagacttgtattgcgggtttaaaagctttttggctaaatcactgtaaacatcaatgtttcccaaaatacttaaacaagctttaccataagattacagccatggttcacaaatcccagtgaacgtaagacctgggggaattgttaaaacctaggatttcatagctctagtcccagagattctgattcagtaggtttagatttggctgtgaaaatttgcatttctaaacatgttcccaggtgtcttagttcgttttcacagtgctataaagaattacctgagactgggtaatttatgaagaaaagaggtttgactcacagttctgcagacttaacaggaagcatgactgggaggcctcaggaaacttacaatcatggcggaaggtgaaggggaagcaaggaccttcttcatgtgatggcaggagggagagagagcgaaggggagagctgccacactcttttaaaccatcaaatctcgtgagaactcactcgcctttagacctacaataaaagtctctttcctacttctctccaatctttcatgctagaaaatatatattcatacctagccccaaatgaaatttacaattttttaaatttaattaacttcttctgttgtctttcactgcaatacctgtgttgcctctttaatcccaacaataagactttgtttaaggcattattaaaattttatataataaaaaatgtatatatttaaatatatctatttttattataaaattttatataataaaagatctatatcttatgtatatatacatatgtgtatgtgtaagatataagatatacatcttatatcttttattatataaaattaaaattttatataataaaataaaagatataaaattaaaattttatataattaaatacatattatattatatagtattataatagagcacaaagcatggttgaagacttcaaaaaagctgcattctatcaaataacatttataaaattcgaatgatcctggaaaatacatttttaaaccaacgaaatatgagtaatatggtctcagatcttctatgccttacaagaaaataattatattacatgagatacagtggtataacactcttaactaaactgatatttctttaaaactgttttcaaactttcaggtttgttgtaacggagtgctctataaccccaagcctggacatcgctgttgtgaagaaaagtatatcccgtttgttctgaattctactggagtttgttgtggtggccgaatacaggaggcacaaccaaatcatcagtgctgctctgggtattacgctagaattctaccaggtgagggttatttccaggtgtactcaaaaactatgggaacctgaaaacataaacacgtggttcatgtcagtgaactatttcaaacacctccctctcaacaaaaattgaaccataaacacatagccaatggcctgctctaaatattgtttcttccttctgctttgttaaaatataagcaaggctaaatattagaaaacgagagaacagaaggaatttacaatatctactacagaaagaaataaatctggagatctggctaactccttttatcttgtggctttttttattaacatgactatatattttcactattaaatatgtgaattgctgactgttccaccccatgaagctgttccccacttcctccatttctaatctgaactacacatgcattgttcttggatagatcgcaactgcaaatttcatttgtctgagaattctaggccactggcaatattctctcatcataagtcaggcaagggaaggaagaatgctgcaaagggtagcaaactggattttttccttcatccctttttagtattagccaacttagctagccattttgctccaaatttcaactacataaaacaatgcctagtgaatataattgggaatgatgctaataataactgccatttttaaagtaccaagtctctcgcaggctctgtattgaagactttacatgggataccttatagaatcttcacaactccaggaaatttgtattatacaaggcagtttacaagtaaggaaactgttttagagaggatcaataacatatccagattcacagatgtgcatagaagtgaaagaactaaaatgtgaatataagtatgtctctcctaaatctatgctcttttgtgtactttactgcctctttaaccaaaaagcatcaacctcttttgacaatttttttaaaaggactatttaagacttctaaacttcttcattactaccactgtcagttacaatttatcctgcaaaagtaattgagaatacaaaagtaattgagaatacaaacttttttctactacttaagtttgatactgatatcttctttaaagagcaggaaatggatataggagaaagacaagaaagccaagttttttggaggccataggaaagctgaatactttgagatatctagtttagggtgaaatttatgcccaacgtctggttcctgtaaattatgttcagtataactatatccatccaaggcatgtgaaatgagacactgtctaacccagtgtctgttttgcaaaatactggagcaaatatagaaggcgtgcaatcacctgatgggttcatcttgcccattgcacagatagagccaatttaccaaaacagtggtattgcaacagagaaagagcttaataaatgcagagccagctaagcagaacaggaggttttactcaaaacagtctcccagaaaattcaaaacctagggtctgtctgggcacggtggctcatgcctgtaatcccagcactttgggaggctgaggcgggtggatcacctgaagtcgggagatcaagaccagcctggccaacatggctaaaccccatctcttgtaaaaaatacaaaaaattaactgggcgtgtggcaggctcctgtaatcccagcttctcgggaggctgaagcaggagaattgcttgaatctgggaggcagaggttgcggtgagccgagatggtgccactgcactccaacctgggcaacagagtaagactctgtctcaaaaaaaaaaaaaaaaaaaaaccctaggggtttttttggttggttttttgtttgtttttgttttttgtttgtttttttatttgtttgtttgttttgagatggagttttgctcttgttgcccaggctggagtgcaatggcgtgatctccggctcactgcaacctccacctcccaggttcaagcgattctcctgcctcagcctcccaagtagctggaattacaggcatgtgccaccacacccggctaattttgtattttcagtagagacaggctttctccatgttggtcagggtggtctcgaactcccaacctcaaatgtctgcccaccttggcctcccaaagtgctgggattacaggtgtgagacaccacacctggcccagcctagggttttttttaggatagtgcagtaggcatagggctagggaatgaggaatgcttattggttggggataaaattatagggagtcagagctgtcttcttgtccttagtcagttcctggatggggactataggatcagatgagccagtttactggtctgggtgatactagctggtccctcagaataaagagtgtgaaaaatagctggtccctcagaataaagagtgtgaaaaatacgttgaacaccaatcttaggttttacaatagtgatgttatctatggaagcagttgggaaggttaggaatcatgtggcctctggtgccatgaacacctaagccgtagttccttgtggctaatttgttaattttataaaggtgctctgccccccaagcaaggagcaagtttgtttcaggaaaggactatcatcagtgtttcgaagttaaactaaacacctctcatagttatcttggcctatgcccaggaatggacagggtagcttgtaggctagaagcaagatggaattggttaggtcacatttctttcactgtcataattttccagtgtcaggattttcttactgtcataatttttgcaaaggtggtttcaggtgtcctgattaaatactgctcaagttttctcaaggcagagaaccttcactcattatttttccttataattaatagaaaaaaaaagtttgtatagcagtgctgttatttcttattctctatcaaaaatatttcaaaattgaataagttctagtaaaccagattttccacttaagaaaaagtaaaaatatatatggaaataaggattttgtagaaaactgttaaacttcttcatactacagctcacgatgtcaacaatggatcaaatactgttaaatgctttactttctcgaagtaacttaaatttggggagttttcatgtatgattcatatctgcccttgattacaaatcattgctataaaattataattacagtgatcagatggacgttttgtgttgttcaattcctaccattcttcacaccagtagaccaagttgatcatggaactaagtaatagtgttttcatttccacatcacattaaaatttttatgttatgatttgcaacaaactattcaaactctacaaaatatcctctgtcccttaaaactaatgaaaaattcttagttacatcttcactgctgctaactcaggagactggcctgtgactttctcaatgctaacataagtagtcagattttgaaccgacagcacaatctacttttgttaggtttcaaaataaaatttaacatttttcttaaaaatgaaataactcatggaagctcagaagttgtcattgatattatataagcctttaataattaatttttagaccaaggatttaaaaaatatgtattgtctgtatgtataaatacatgtttctgcacacctaaagcattttaatatctaccaaaccattgagcatgccccaaattttgattcttttttaaatagttcatttttcatagcattagaatgcataccctggtgtcaagaaaaaaggaaaaaagcaatctcatgaaataatcaaagagtgttttgctccaatcattaatcccactgtacctaaatgaagagattattttgtgacctctgtcctcagccccgtggtctttgttagctagtttaacactggttacactgagggggaaaaaagcgcaatggtcccaaatcctgttgcatctaaatgtgatttaaatctggtcactagtctgccagttcaaggccaagatgggtataggcattttgatatttatggattagcctgaaatattggtaaatacgtactttattttttttctcatgactttcttccataacaccccataacaaacagcagaagaggaaagaatgctcatttctctcccttttttaataaatatgctaataaccccaagtaaatgttaatgtgggtcattctttgataagaataacaattaactgttagactgcatggtagtttttagagagaaaacattttcaagcctggcctgaaatagattcattttgagaggttaatgagaaggtgactgatccttgtatcttatgtctaatagcccctttttgaggaaaaaaaaatagttttattttttattgatataatccacatctttttttttttgaagacttttcttctgtcagtaactaaataagattctgagggattcagaaagacatagctaaaatatctaaaccaattaacatttattatgctcaaaagaggctttaaaaaaaagtattggctttcgccatgtagatgtgtatactatgtttcctctaagctcaccattgtcctgagtggtgtttaattaactgttgttgccctgtaccatgggatacattatcttaaagtttaccatagagggacattatgttctttgactgtgaagacaaaaaatatggcaactacatttcagacgaaatagaattattttacccaggggaagataacaaatacagtaactttactgtttacaataagctcgttgctccttcattggtctctggtagcatcatcatggaaacttttactaagttccctttttcttagagataccatattataggatcctttcaaagataattgactaagccaactgtctcctgaattctagaaattcatattttgagaaaatcctgagtatgtcttgatccggtcctggatatttaccctagagaaaagcaaatttatgtttacacaaaaacctgtacatgagggtttacagcagctgtaatcattactgccaaaacctggaaacaattcaaatgtccctaagtgagtaaatggacaaatgtggaacaaaggaatactatgtagcaataaaaaagaacaaagtattgataagtgccaagaagatatcaagcccagtgaaagaagccagtctcaaaaagctaccaactgtgagactgcatttacatgacatactatacaagacaaaccatagttttggagaaaaaagttgacaattgccaagggtaatggatgggaagggaatgtgactatacagggatagcgtgagggtgttctgtgggggtgatgaaactcttttgtatcctgatggtgtttcttcattaaaattcatggaagtgtgcacccaaaaaaactaatggtcctgaataatatttttaaatgaaatatttttaaaacactatttccattttacacataggaaaaatgggacatagaaacatgaccaagacactcagctagtcaaaataggaattttcatggttaaattttaggttgagctcctagagatggtgtgttttataataatgtgatgactgtgtatgagtgacttaatatatttttctcatatgttagtagaacagtaagatagcaaatatatttccattaaaattacaatgaacatccctatctttaaaagaaagcaaaaatgtcttagtcagtgatgactatttcaagtaatattttacatgatcacattcttatgaaagcataagttttgtgtagtgtttccgtggtttgatgctgaataattagtgaataagatattggttctggagtcaaactgcctggctccatatcccatttctttcacctcttagttgtttgaccttcattaagtaactttaggaatattagcagggtattaatgtttctgatgtccattgggctgctgagttagaatactcaaagctaaccctatcttttatatctaaatagaaaaaaaatgtttagtaattgaggagcatatgagtaaagagggctaacaggcctcctttaaatgacaaagtttctaatgaatctttccagagcaaggactcaggggtgtccactttcatcagatcatgtaaagggatagccagttcccaaaagctaagattcaaacatctaatgacctttgagatcctatgaaacaaaggatccttgttgatcctatgaggccaagcaattctctaagttgacttttagcaactagccagggaaagtcatgaagagcttccaaactttgaagagaaaaagactttccattttgcaaaatgtcacagcctagaatttaggtcctagaaaaagcattttgttctgacaaaattgacatttagagactttatgtcgattgtatgctaccactattgacaaatagagggaatcaatttttcaagtctatctggagaacgtgacagatgatcattcacatattgcacaacagttgaatcttataggggaaattaaatatcgctcagtttgtttcctattgctgctataaatcatgaccagacacttcgtggcttaaaaccacacaaacttactttatacatccaaatatcaaaagtttgaaatgggtctcattgaactaaaactaagaagttaacaagagctgcattcccttctggaggagagaatccattttcttgccttttccaccttgcagaggctgctcacattctttggcttgtggaccccttccattttccaggccagcaatgaccagttgagcctttctcacttcatattattaaacttaatcacatctgttgtcttcattcccctttgccatgtaacataacatagtcacaggttccagggattaggatgtggacatcttagggaggccatgttgtgcttaccatggtaaggtaatggttaagcagttgtgagaattaagaaagcattgtcgtaaactcttggggaataactgtcacaagtgaaacaaaaaaagatactgtgagcctgagtgcaagaatatatgaaaaaaatgctaagtatagatttgctataaattaagcagctgcctcagggagtggcagtaggatgatattagggttgggaactacagggaaatgggggagtgcaatcttgttaatgacacttaaatcttgtacaaagtggtacacaagtcttttatcattttgatagagtgaacagtgaactacaaggactggtacaggggataatggggtgttatgccaagcgaggtaactttctagaggtatgtagatacaatggaccaagttattaaatattgttctttttagtagattttgggacagtttcaagaaatgcatagccagattgatagacatctttaaggggttagcatcctgtatgaatcccacatctgagcagtttttgccccagaggatcttggagacacattcaaagtcagagatgttgataacaaaggcatcaggtaattagctggtgctaccaccaaattataggccaggcattcttctcctgggagttacagaaagagactttcaggtgcacatttaatgctggtatctcatttacaaagtggatctcttctcaacagatgcactgaagtggaattactaaacaaaaaatatgttgattcaagagaaagaaaagaaaaataaaggcagaatctgaaaattatttgatatgtgtaccgctgagacatttggttattcctagaaagggataatggaaaattagaagggtttttgatagataatatacctaccaccagtatcaatcttctatttttacaattgcatagaaatttctcactttctatgtcaagggcagttatggatagatgagagcagctactttcacagagaggtgctgttttgtcagtttgtccttttttttttttttttttgattgtgtctttctaagatacactaataaaggcaaagtaggtgttctcccagtgtcccttacaatattgaaagttgtttttgtgcagactagacatagaggtgccctcattcttggctttatctaattgcttaatcccaaaagctgttaatgtggtctgaattttttttctttttttctgagccaaagtatcttctaagtgcttagcaagctcttgtaatttagaaggaagggacaatctactgtcttatcttctgttttatgggaagttatgataccttcttcactgatctttagagtattctggaaggtggtagttaagtgatctctgaagccaggcatggatttattttttccttgtttacaggacttttttgtggtaaagtatacaccacataaaatttatcattttaaccattttttaagcacacaattcagtggcattgagtgcatttgcattgttgtacaatcattaccaccatccatctctagagctcttttatcttctcaagctcagactctgtttccattaagcactaactttccactccctgttatcttcaacccctggaaaccaccattctgtttttggtctctatgaatttgactactctaggtacctaatataattggaatcatacaatatttgtctttttgtgtctggcttatttcacttagtgcattttctttcttttttttttattatactttaagttttagggtacatgtgcacaacgtgcaggttagttacatatatatacatgtgccatgttggtatgttgcacccattaactcgtcatttaacattaggtatatctcctaatcctatccctcccccatctccccaccccacaacaggcccctgtgtgtaatgttccccttcctgtgtccatgtgttctcattgttcaattcccacctatgagtgacaacatacggtgtttggttctttgtccttgcgatagtttgccgagaatgacggtttccagcttcatccatgtccctacaaagaacatgaactcatcattttttatggctgcatagtattccatggtgtatatgtgccacattttcttaatcctgtctatcattgttggacatttgggttggttccaagtctttgctattgtgaatagtgccgcaataaacatacgtgtgcatgtgtctttatagcagcatgatttacaatcctttgagtatgtacccagtaatgggatggctgggtcaaatggtatttctagttcaagatccctgaggaatcgccacactgacttccacaatggttgaactagtttacagtcccactaacagtgtgaaagtgttcctatttctccacatcctctccagcacctgttgtttcctgactttttaatgatcgccattctaactggtgtgagatagtatctcattgtggttttgacttgcatttctctgatgcccagtgatgatgagcattttttcatgtatcttttgtctgcataaatgtcttcttttgagaagtgtctgttcatatccttcacccactttttgatggggttgtttgttttttcttgtaaatttgtttgagttcattgtagattctggatattagccctttgtcagatgagtagattgcaaaagttttctcccattctgtaggttgcctgttcactctgatggtagttttttttgctgtgcagaagctcttgagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttgatccatcttgaattgatttttgtataaggtgtaaggaagggatccagtttcagctttctacatatggctagccagttttcccagcaccatttattaaatagggaatccttttcccatttcttgtttttgtcaggtttgtcaaagatcagatagttgtagatatgtggcattatttctgagggctctgttctgttcctttggtttatatctctgttttggtaccagtaccatgctgttttggttactgtagccttgtagtctagtttgaagtcaggtagcgtgatgcctccagcttttttcttttggcttaggattgacttggcagtgtgggctcttttttgggtccatatgaattttaaagtagttttttccaattctgtgaagaaagtcattggtagcttgatggggatggcattgaatctgtaaattaccttgggcggtatggccattttcgtgatattgattcttcctacccatgagcatggaatgttcttccatttgtttgtatcctcttttatttcattgagcagtgctttgtagttctccttgaagaggtccttcacatcccttgtaagttggattcctaggtattttattctctttgaagcaattgtgaatgggagttcactcatgatttggctctctacttgtctgttattggtgtataagaatgcttgtgatttttgcacattgatgttgtatcctgaggctttgctgaagttgcctatcagcttaaggagattttgggctgagatgatggggttttctagatatacaatcatgtcatctgcaaacagggacaatttgacttcctcttttcctaattgaataccttttatttccttctcctgcctggttgccctggccagaacttccaaccctatgttgaataggagtggtgagagagggcatccctgtcttgtgcccgttttcaaagggaatgcttccagtttttgcccattcagtatgatattggttgtgggtttgtcatagatagctcttattattttgagatacatcccatcaatacctaatttattgagagtttttagcatgaagcgttgttgaattttgtcaaaggccttttctgcatctattgacataatcatgtggtttttgtcgctggttctgtttatatgctggattatgtttattgatttgtgtatgttcccattcatgttgtcgtacgtgtcaggattttattcctttttaaggtcgaataatgtctcattgtatgtatataacacttttgtattcatttattcatcagcggacattggggttatttctgcctagtgactattatggttaaagctgccataaacattgatgtagaaatgtacaaatttctgttcaatctcctgttttcaattcttttgggtttatacccagaagtggaattgctggatcatatggtaattctatgtttaattttcatgttaagaactgccatactgttttgtggaacattttaacattttatattcccaacaacgcataagtgtgccaatttctccatattcttactgtttattattttatgttttttataactatcctaatgagtatcaagtggtatctcattgtggttttgatttgcatttccctacttattactaatattgagtatattttcatgtgtttattggctatttgtatgtcttctttggaaaaaagtgtctattaaagttatttgcccatttaaaaaataaggtctttgtttcatgtttttgagttatagaagttctttatacattctggatactacttccttatcagatatataattttaatatattttctcatgagttgccttttcactttgttgacagtgttctttgatgccaaaaagttattaatattaattatgatgaatccaattcatcttttttccttattgcttctgctttcagtgtcatagccaagaaatcattggcagacccaatgtcatgaaatttcccctttgctttcgtctaagaattgtaagttttagcttttacatctagatctttgatccattttgagttagttttggtatatggtataaagtaagggttcaatatcattctttggcatgtggatattcaacttttccaacattctttaaaaaaaaaaaaaggtcctttcctcattaaatggtcttggcacttttgttgaaaatcatttgcccatatatgcaagggttcatttttaggatctctgttctatcccattggtctatgtgtctgtctttgtaccagtaacacacttttgattactgtaactttgtagtaagttttgaaatcagaaagtgggagatctccaactttgttctttttcaatgttgttttgactatttgcagttttttgagattccatgtgaattttataatggcttcttctgcttctgcaaaaagcattgggattttgatagggattgaattgattctgtagatcacttgagcagtactggcaccttaacaacattaaggctcccagtccataaacatgggatgttcttccatttggttatcttctttaatttctttcaacaacattttgtagtatttcagtctttcgctttcttggtaagctcattcttaagtctttctttttttgatgttattgtaaatgaaattatcttattaattttattttcatgttgttcattcttagtgtatagaaacatacctagtttttctatgctgactttgtatcttgatactgtgctgaattgtttattagttgtaacaggttttttttttttttagaatctttatagttttctctatatgatatcatgttgtctgagaacacatagttttgcttcttccctttcaatttagatgccttttatttttttctcttgcctattgctctagccataatatccaatattatgtagaatacaagtggcaaagggtggcaaccttttcttgtttctgattttagaggaaaagttttccgtctttcactgttgagtatgacattaggtataggtttttctcatatactcttgattatgttgaagtagttttcatctattcctattttcttgagtggatttataatgaaagagattgaattttgtcaaatatttgttctacatcaactgagataatcatgtgtttcttttttttcccctttgttctattgatataatgtgttacattgattaaattttcatatattgacccatcctggtattccagggatatatcccgcttggtcatgttgcagaatcattttgatgtgcttttgaattcagtttgctagtattttgttgaagatttttgcatcaatattcatgagagctattgattttaacttttttcttgtggtttctttggtaagttgtatgtttctagtaatttgctcatttcatctagtgagatggatttttggccaataaatttggaaagaaaagatctcaaggatagctgctgagagttattgtcttattatttatactccttatatatctatgtttaattaaatattgtcccatatttttatatcattttggtaaacagtacatcttgcttttactaaacaaattttaggatatccagggctcaccaaaaggtgaactaattgagaagaagtccaggactataaatccctaaggcagtcctaaattcttcagtggatttgtgccatttcttaagaaagcttgacaagtcattaattggattatagaaatcttacctggaccatggttgaaggccataagacccatcagattggtcatcatactcacataccttataagatataatgaagagatgttgtccaggggaaaagatatgttcaagaaagaacggtagagaaaagggaagaaggtctgttgaaggtgtaggaagaagaggaggagcaggacaaaagagagaaggaagtcagggttccgaaggccacgagggaagacaaccacagtggggtcatgagatagagaagagaaatgaagcttggatttcagatccaccaagtttttattagttcttttgaaggtatccttaagggaagccatttacaaaatcttctgtcctttagagttgtctttataccaaacaaacaaacaagctaactcttggtatttagagtatttgagtcctttgattttaaggtaccaggcaaaagattatctaattctgttttttgttttttttgtttgtttgtttttgttttttagatatgcccaggctggagtgcagtgaaacaatcctggctcactgcgcactctgcctcccgcctcccgggttcaagcaattctcgtgcctcagcctctcgagtaggtgggactacaggcatgcaccaccaagcctggataatttttttatttttagtagagatggggtttcaccatgttggccaggctggtcttgaactcctggcctcaagttatccacccacctaggcctcccaaagtgttgggattacaggtgtaaagcaccacacctggtggattatcttattcttatcccaaatttcccagactgtcatgtgaagagaaatgtagtaaaattcagtgtgtgacatagcccagagaagtactagcacactgacttaaatacagtattttttacctcctctcatgtaattaaccttcccaatgggagtattttgtttggttgaacaaatatagtttggtcaaggaaattatagtcataagcaatataaatttatcaatagttggtttttgaatccactctacgttccaaaagaaaattacacagaacaaaaaagtattcctagatgtttttctataatgccacatagtccatgtcaccagacctgatggtgaggaaatagacaacatagacttacctgtaagttgccatgtgtgtatctgatctgacacacgtttatacacaaaaactttggagtcatttggaaattttgcaactccaatatgatattattctctttagtaattctgtcaatcagttgggatctgcaagatgattgtgataaaagttaattgttagtcatagcatatttttttaactgatgtaatgattattattgtcctaaattgacaggtgaagtatgctgtccagatgaacagcacaatcgggtttctgttggcattggtgattcctgctgtggcagaatgccgtactccacctcaggaaaccagatttgctgtgctgggaggcttcatgatggccatggccagaagtgctgtggcagacagattgtgagcaacgatttagagtgttgtggtggagaagaaggagtggtgtacaatcgccttccaggtaaggggcccaggtctacctttcagtagatggaggatctgagaagcagagagagtgagaaatttgccctagaaataaaacaaataagtaattaaagctcacattggttatatctaatgcaataattaggaacatattgtttaacacataacaatgtaatctcccaatttttacatgtatctcatgtatttcataaaaacgcatcaattttttttcctcttgaaaaggtcatgtcctccaaaaaaaattccacacatgaatgcattggttatgaatgaaaagaatatttcctagcaaatagtatacaaaattattataatgatattttgttataattcttttactcccttattctactgtattaagctaacactaatataaataacaataagtatcattgaatgaatactaacagacactgtgccaatattttatatattattacctcaaataatcttcacaataatcttacatgataggtactatcaattatctgcattttaaaaatgaagaaactgaagttcagacattagatattagacattatcttgctaaataccacacagtcagatccagattttgggaagcctgacatttatgttattggaggtggggcttttaaagacaagaaaattaaaatatgaagttaatgttcacagtatcttcaccaggcatagattccatctcaagaagccactttctttgctcctccctaagaagcaactcctcatctgttagttttatgattgcagcaattcagttacctcttcaggcttcacttctcattccagttctcttgctatttccactgcatctgcagttatttttcccattttgagtctaaaaccccttagtcatccatgagggttggaatcaacttcctctaaactcctgttaatgttgatattttgacttcttcccatgaatcatgaatattcttaattgcatctagaatggtgaatcctttccaggttttcaatttactttgtccagatccatcagaggaattactatctatggcagctatagccttacaaaatgtatttttaaataataaaactggaaagtcaaaatgactacttgacctatgctgtgttaataggcatgtaaacattaattttcttgtctatttccatcagagctcttgagtgaccagatgaattgtcagtgagtattaatattttaaaagaaatatcttttttctgagcagtaggtctcaataatgagcttaaaatacatagtaaaccatattgtaaacagatatgtaatcatacagcctttttgttccatttacaagcacaagcagaatagatttagcataattattaagggccctagagtttttgcagtggtcaatgagcatgggcttccacttaaagtcaccagctgctttagccccccagcaggagagtcaacctgtcctttgaaactttgaaaccaggcgttgactttttccctctacctatgaaagctctagttggcatcttcttccagtacaaggctatttcatctacaatgaagatctgttgtttagtgtagccaccttcatcagtgatcttacctaggtgttctgggtaacttgaggcagcagtttctacatcagcacttgctgcttcaccttgcacttttatgttatgaagatggctttttttcttaaacctcatgaaccaacttctgttagctttcatctattcttctgcagcttcctcatctctctcagccttcatagaattaaagagagtaagagccttgcctggactaggctttggcctaagggactattgtgactgatttgatcttctatccagaccactcaaagtgtcttcatatcagcaataaggctgtttcacttattcataagtgaatgataagtgaaatagaaatcttacctggaccacggttgaaggccataagacccacaagatttgtcatcattctcacataccttataagatataataaagagatactgtccaggggaaaagatatgttcaagaaggaatggtacagaaaagagaagaaggtctgttgaaggtgtgggaggaagaggagcattttgattttcttcaagaactgttcctttgcatgcataactgggctaactgttgggcatgagaggtctagtttttggcctgtcttggctttccacatgccttcctcaataagcttaatcattcctagcttttgatttaaagtgagagacatgagactcttcctttcacttgaacacttagaggctattgtaaggtaattaattggcctaattttaatattgctgtgcctcagagaataggaaggcctgaggagagggagaaagataaaggaacggctggtctgtgaaacagtcagaacacacaggacgctcatcaactaagctttccgtcttatatgggcaaggttcatgacacgctaaaacaattaccatagtaacatcaaaggtcattgaccacaaatataaatataaaatataaaaattaaaaatataaaaatataacaaatataataataatgaaaaagtttaaaatattgtgagaatcatcaaaatgtgacagagacacgaagcgaacacgtgctattggaaaattggcaccaatagacttcttgatgcagggtggccacaaaacttcaatttgtaaaaaaatgcagtctctgcaaagtgcagtaaatcaaagcacaataacgtgaagtaagcctgtgatactaaactactatatgcctttttaactcttattctctcctatgtgtacagcagagcttttcagatgttacatggcatgatttgcaacagatcgaatgcagactcagaaagaaaattaaattgacttctcttaactaaacatttaaaaagcttgcaaaaatataacacaatgtcattcttctattttttatttgaaaaacatttattttcataaatatgttagaatgttatagatttattattttatgtctaaatgcattaataaatatttcaaaaatttctgccgtaagttttaacacagtacatatcaacaggtaaaacccatataaacaaaaggtatttggggtcctcaataattcgtaagcgtataaaaggatcctgagaccataatttgagaaccactgcttaaagtcatagtaacgtctactagaaaattatggcaactaattagttatcctgtactatgactaaccagttgaatacctcctcctcctttagatgaagtagctaataacaggtctattaaagatagaaccaaggtggcagggagggtgcaaaagtgttacctcctgtgtactctaatacatcagagtttaaaaatgacagcaaaatatttgattttagtgtgtttgttcatctgtagctttttaaaagaattagtcaactgctatactccgtcctttgttaaatatgtattatgtagtaaccatattcaagacatcattcttggtgctttgcaagtgtaaaaatggccaagattccgtttttatcctcaagaacttacaacctaatcaaggagaaaagtgcctacaaggttatacacagaccataagagagggatgaatgcatgcatattcttaagacggagagatcactccagtcaaggtaatgaagggggttgttccattggattggaatctcaaacagtgagtatgattttggcaggtgtggcttgagctaaactgtgaaattagcaatctgcaaaacacaaataatagcgtgtgctttggtttacaggaggtatacactctgtgtaaggaagaaaggagataaatctgagtaggcaaaaggatttgaacattatttagcactcagggaagagtcaatatgatgataagaactgtagtttaagattaaatttaggtgtcagaacaaatacaatagagaaggaaagagaagtcagaacacccctggcatgaagtaaaatacatctgttctaagaagtggaatggaggttaccgtccactaggacaatggttcttaacttgttttccttttgaatcttttggaagttacaaaccctcactctgaataatagtgcatggaatatacacaaaaatttgcctgtaattttatccacccttgaactccatccatgaactcaaatttcagaatcacttctttatttactccaagatgatgtcgcatgccagtcaaacatttcttacacaaatggtgacagccctcaactcttgcgaatcaagataagctctagagtttctcatggcattctacagctctgccaactctgataatcatagtggacttaaggaataatagttttacaaaggaaaaaatatatctttttattctcttgactttctttctgcaggttgcactgaaaatagacagattccacatgtatttttcctctctctgctgccgttcactcctgtagcccctaatgactgtgaccttaatgaccttccagaatatccatatggccctttttctcctcaacctagcaacaaacagcatacctgctacataagtgtttggatctcataatatcgttcctaagcctggcctctctcgctgcctggcattgtgtgcctgccacgagaccgggctggctcgtaaaacatctctttatgtactttattacttaaactcttttatttgcctgcaggagccctttaacaaaatcacattgaattgactttctcacaccaaatcaaatctccctggtcccagttcagttgtctttgtcaatatgtattttataaatggagtgaattaacagatgctgttggaacagaagtgctggggtggcgtttatgtttttagtgctctctctgggcagatgcgttgtgtagaagtgttatacaggtatctcgggatgaaagtcatgcgtgtcatttcagtggatatgtattcttagccattttctttgaatagattttaaacctatttattactcatttttttcttagtgtttgcttatatagctttatcatttatgccattaatcttggattggacttgattatatcccttagtatgaaaaggtgaaaaattaaaacctccgtttcattcaaagaggacagatttttctattagccatgggaaactgatcatgagatgactttggaatatattgacttatttatattataaactttgtccatgcggcctttgatgtgaaactctgagttgaaattgtttcagaatacaagactgagttttcatgtcctggactctgacttcagtagaacaaatgactatcgctgtttgtttcataagatgggaatttgggaattttgcagagggaagtataattacagaagtccatggtgtaagggtggcattgaaaaaacatttccctggaagatttccataaaacagaatgattttttttttgaaaagtgtaatatatcagtgctataaaatgtatcacaatgatttggggagcatttttactctaccctctgttttgtggtggtagtcacagagccatctactggtgaagacaagtgtgaatttcttttctttcatgctctgccacaaatgttatacatttgtcctaaggatgactaatcacaaaccttttttttcttctaggcctaaaatatcccttggcttaaaatttggtccccatgaacaatctcagagtttcacaatgatttgtcatattccagactggattttactactatactatttttatctcaaaggcatgatacataattcttggtcttctttaaaaaaaagtggaatcccagttttgcagtcttaactatttagaaattcatccaacagatatgcttataaatgcttttctttttagacatagatatgaaataagcattggtaacatatttgaagtattaataatattgtgagtaaaaattttttcctccactattttctcagttgtgtccaatcaatggaaaccattggatatatatacagtttagaaagacaatatatgctttttcatctgaaaaataaacacctactagtttaatgtgtactgtaccactttactaacatctgcattttgttcaaagacacactccaccttttgtacaaatttaatgaagaggctctggaagaatggaccaatccatcaataatgcatgacctattttgtttttctttgggcatatttaaaatcgtgcattccgtgtgtcaaagttcaaaagtcaagtgctacatgtgataaattaggtaggggtcgaaagttattgcaatgcagtttcggaagattgtctgtctctgaatttgcagctcattcatgctgaagtgatgcactatgggaattactaccaaactctgctccgcaacatctgctctccctaagtgagttagtgcacgtcagacatctttatgtcagaatattgcagtgatggatgcagtcttcagaaaatgctgcataaaaatctggtgtgccgttctggccattaagtgaaattactatttaaattaatggcactgtcacagtttatctgtgcaaagaatgaacgctgattagggtattaagtaattagcaatttatcacactggaacaaggttgataataattaaagaagtaatggtttaccaaagaatctaaaaagggagtcacttcttgttatgtgagtgaaatcttggctgaaaatttcaattcagtaatacaaagatgaagctctttgtgaaagaaggcatcttttttttctagtttaaaaacagttcattatcaaaattttagttgacctgtcagaagtccctcagagtgatcagatgactgattaggagtttcaaattaggtcaatgtctgcatttttattttatacttaaagcatagtgaaaccatgaagtaatttgggaatgagagggggagaatatattccgctccctaaagggccagttttcaaattttgattgctctttaaaagagaaacatgaattgtcttcagaaaactgccagagaaaaaattaacagtaaaaaaatccatggttgtatttaaatgtctaatcagaaggggcagaaaaatgcccgaacaatataaaacttgaagctacggatttttctttttagtttatgtgtgtgtgtacactcatgtatgtatatatttatatgtatttgtgtgtgtatatatacacatacatatgcatacatacatagctacacacacataaatatgtgtatttgggtatgtacttatacatacacacatatatacccaccataatccagactcagactaaaatgagccctgctctttgtattaatttgagataacttttcctagaaatgttaaaaccactaaaattataaatatagcagttaatttgtaaaccaattacttcgaagagttatcacattagataaacatggtatgccaaagctctgttagaatcagtgtatatcattaatcataaataagagtttttaatattagagacttttgtaagtaaaaagatgaatgagagggttctttggagtcatgtgtggataaacatctttcttaaggcatgtgccaaaccaatgtctactttcaatgattttttttaaaagcacttttgatcttttatttgagtgtctttaataatgtagatgtttacacaggaccagattaaacaattcaggaccccagggcactttgaatttgaggttctttatgttatcagtcggaactaataataaacaaacaaaattccaattaaaataaatcattcatcacattgtgctgctatataactggatataaattctaatataaaaacactgtgacatgcagtatagccaccttgatttctagcttgatctgtctctagagtagtgttaatttattcctgctttaatgttaaaatttctgccatttctctttgatggcaatatctaaatgatgcaaatgcaggtaattaaactaaatttggtgggagaaaatgtctatttggtatctcaggtacgtgtgtctttcgtttagatgtggggatcagtgatcctctctacaaggtctttctgcggctgcccccagcctgtcacctgtgtctgtgatgggtctagaacagagtgaggctcaaaaaatagtggctgattagtgcacctgatcagtgaacatgctcagctgattatgaataaataccaaatccatctcatgcagaaaacatggttaccattgcagctaaattcacaagaaacaaatatttgtaccctaaataaagctaagccaaaacttgcactgcttctcccgcagggcttccagttctaggatggtgctacctttccactctgcctgggcttttatcccagagtacttgggtgaccttttctcccttatgaatttctagagctttctcagagtccctatagtttaactaaccttcttctgcaacaagatgttatcatcacaaaatgcgcaggcagttttcatgacagaaatcctatctctttttatggagcatgagagaagtttggcccagctgaatgattttcgaacatttcctcttgtgtgttcttttcctaattagtgtctagtgctcttggtaagaaggaccctcactgcacatttaaatcaccttggtagggaaatgctaccttaggtattgcaccatttcagcaactgcctgagcctgacatttttataccaaactttatagcagcctcagttttcttccctttttctatttcatattcatatataacattttattgttgcaggtatgttctgttgtgggcaggattatgtgaatatgtcagataccatatgctgctcagcttccagtggagagtctaaagcacatattaaaaagaatgacccggtgccagtaaaatgctgtgagactgaacttattccaaagagccagaaatgctgtaatggagttggatataatcctttgaaatatgtttgctctgacaagatttcaactggaatgatgatgaaggtaattgatagaaaagctctcggaggcgctgatttgacaatggaaagagaaatacattgttcataactatttttctaaaataggaatataaaaactcctgtgtgcattattcattttcacattacatccatattaataccgaatgagttcgctatgattgatgttattgcaatgaattctaaaggaattaataatgattagctgttctcagggaagctttacccagcacttcagattagtgcaggactgaaagtctgtgtgccactgaaagagccagcacaggtcgtctggggcctctgcatggtgccatttcatgcctgggagcactgtggatggaggcaggaggaaattcccgcttcttctccctagcccgccagccatcatccaccactttcctttgatagagaccttagatccagcaaattcgcttagttgcatttatatcatattcccttggacaatgcaagatgagcaaatgcctgtgtcaaaagtgaatgaataggcttctgggtgtaatcgcttatgtttttgtatggtgatggtttgtacacagccatgtcatgtatgtgggtattaaacttgacccaggataccagaagcctatcaatttaaggaaaggaccatggacactttaaaaataaacatgctaccgtgttctgtagtaatttgtcattataagaccactaaaaatgggtgtcttggtcacagacaatggaaggacgcttgttcaatgaggcaactacacagtccttgtgtagaccacatacactttgtacactttgggatgtaaaataactcatgagattgttagaagccctgcaagcactttgtatcaatgaatgattaagataacacataaggttggttaaattattctaatgaggacaatatttctccatgctgaatcaagtagtgtgtatacataataatgttcagtctgtaggtttcattttgttttctgaagacctaccacctggagacatttatatcctgttccagtctggaatggatcaccatgggatttttacatagctggcccattcggtcttccctaagctatcaattcaggaattccttttacctctttcctgtgttgattcccctgtttttttgttttgttttgttttgttttgttttgttttggattccaagtttcattccatttggagaattatcttcttgtatatagatgtatggagggtaaattttttaaaagcttaatgtataaaaatactattattttaccctccaacaggattgatagtttggtctgatatacaattccaggttaaaaattatgtctactcagaattttgaggcatttctgcatgttttaagcttccattaatattttgattcctatctctctgttggtaaccatgtttcttttcctatgaaagctcttgaagatgttctctttatcctgctcctctaaaatttcatgacaatgaacctctatgtggaagttaggatggtttctttttgcattttgttttccatttttgtgatgagagcatttaggatctactctcttagcaattttttttttacattacaattcattatgagttaggcagttgtcttccaagtaacatctctagaaccgaagccccttacatcttgtgatgcttcatgcagcccttggatcataatggaaaaggcgcaagaggggacaattgcacacagacagttcctacctggatatagagtacatcctttctatgcactagtcacacagacatatctagtcaggtggcttctcctactgcagccaggtttcaacatcccatgttcccagagagaaaagggaaacatggacatcactgagcacattgcattgtctctgccacattcatctactttccagcttccaaaaaggtatgcactgtcttgtgtgtattatttttctccattttttcttagactttcaacacgtaaaccagtattttactgtcatttagttgggcttttagaggatagatagatagatatagatagatagatacacacacatacacacacacacatatatatatagtgggattctatttatgtagtgtcatcttggctcactgcaacctctacctgctaggttcaagcgattctcctccctcaacctgccaagtagctgggattacaggtgtgcgccaccaagcccagctaatttttgtttttttagtagtgacagggtttcgccatgttgatcggtctggtctcgaaatcctgacctcaagtgatccacccacctccgcctcccaaagtgttgggattatagacatgagccactgcgcccagacccactatatatttttgaatgtactattttgatcaacttggtaagaataattcaacttattttatgtaagagagaggctgaatggagatcaattttaatagcaaaaagtattctaaatacattatgctacttatgtaaaggaaaggcaaagtagatctccacattataaaactattaccttacttatagctcttgtagtgtgggatgattaagtatttaatttccttggattaaaacaaagtggtacttatcaaaaaccataaaaaatctggagatgtgtcagagaaaatgtttataagcgtaaataattataattacaatgacagttcatgaaacatttatatttttaaaaacttggatcagtaatacttctaatgggaccaacttccccaacaacacaggaagtgtaaattctcaaatatcacattctttattttctctaaaattccataggaaagtatcaaatagcaaaaataaaatatttgtagtgtgtatactaagtttaaagacttatcagttttgagtcacacaacaaaccttggtggtaaattatatgatttgagtcacacaacaaaccttggtagtaaattttgtctccatgttccccactgaagaagctgaggttttgaaaacataagtgacttgctcaaggttacagagctgggaagctgcaaaactgaaattttaatcccaatttgtgacatttcaaagtcattgttcttcctagtatacaaactgccttcatttctttttataaattttgaaatattcattcatcaagtaagtggaggaaaaatttcatttgaaagtcacaaaagcctaccctatgtatgtctaaatgaaatttttaaatacccctctctctctcacccctgccacttgactcaggaaaccaaagagtgcaggatcctctgcccagcatctatggaagccacagaacattgtggcaggtgtgacttcaactttaccagccacatttgcactgtgataagagggtctcacaattccacagggaaggcatcaattgaagaaatgtgttcatctgccgaagaaaccattcatacagggagtgtaaacacgtactcttacacaggtaacagaaagcaagctgtctgcccatggcttaatggggttagtgagaagctgctgaaaatgcagatttatttcactctgacatcaactctccttaaactgatatcagtacattccatcatactttgaggccagctagttacaaggtaattaaaggcataatctggatgtattcaaagtcagtactttaaaatgtgttaaagtctatttaaacaaggttgtattccatattaaggtaaatctgtggagatatctgtgacctttactgctatatccagttaatttacaataaatccaatttcctttttcaaaagctgcaatgcagcttccactgaatgcattgaatgaatactgctatactcttaagcagaaagaaggatgaacctgtctgattaataataaaacctaacagtgctactctgaggatgaggtaaacccaagcatgacatttctccaagatggctggtcatctccaaaagaataacctttgcagttattgtaaatattaatttctatgtaccatcttggccctgctgaattagtccaaaatggttatgcttagttttggctgagctgtgtgagaaacactgttaagtttagaattatctctaaaacagttctgccatcaattaaatttgtgttattcatccatttacttaagtccctacaaaatgtgttcttgttttttgaaaaatcaagtttgtgtgtgtgtgtgtgtgtgtgtgtgtgtgtgtgtgtatcatctatcatcttgattcaatagaatccatttaagtgacataatttgagcaagctaaggttaataaacaagcaaaacattgctccattccatcatgaatcatcagtctgctttactcaaccaaggggcaataatggctaacctcaagagtgcagaaagtaaggcaggctactaagataagaggaggaagattaggaagggaagaaaggaacagagataaggttgattgaacattatttagtctcaatgttatactaggtactttaatttttttattatactttaagttctagggtacatgtgcacaacgtgcaggtttgttacatgtatacatgtgccatgttggtgtgctgcacccattaacttgtcatttacattaggtatatctctacactaggtactttaaaaccttatctcagttaccaacaaagcaatcatataaatatggtcatttaacagatgaggaaactgagggtcagatctgtaaaagttactcgccatgagaaagaaacatattcaaataatgccatcatcaaaagggacagactttgaagactccacgtggtgcaggagctcctttcagagtgctccaaatgcacttcaagctgttattccacctgaaatgtcctcctttatcatcctactcaaggcctaggtcaagattcttttcctcaatgcagtccctgtgctgctatggcacattgttcacaaagctcactagctctctcatgtgtcatatggatttggacacttgttccagctcttctattagattgaaacatccttatgaatagggcatttttgtttacctttgcctcgttatttggatttagaacactatacaaacaaaaaatatttcttggaatgaatttaattaggaaaggcctcagatagaggacaatttgtccaaccttctattgtgttcccagtcccagttatagatttaagtcatggactttcatttttaaattattgagtttccatctaagagagttctctacttttatctgccccttgtaatcaagatcaagattttgaagggcttttaataaatacttgtaatagccctctccagaagtgaatagatgtttccacctactgatataatgttatgagggcttttaaaatccatatttcagattgctttgcctgcagaaaatactacaaattgaatatgaaaaataacaaactgttctttttcatgaaagatgttcagcacacaagtggtgctatgataattccattgagaacaatttagattaagtcagactcttttagaaacttacacttgaaagctgacaataccagtgctgacaaaaatttattcatttatgcaatcatttatttatcaaaaattatttattaaatacctactaataactagtcactacattaggactagcagctatgatgacaaacaataatttttcattgagatttcaaccctatatgaagaaagaaggaagcagcaaatgagatttgaaatggtaatgtgggcttgaggatacagaataacagtcattaccaataagtagtttaatttgctgtagcagaaatgtaaaacatattgaccatctgagggtaggtagatggtctaggcaactgaatcgcacaaggtcattcaggtatccagaatccagaatggcaaccgaaggtatgcaattttctctttataaaatgatgtggaagttgtcagtgtctttctatactccttcaagtattgagatctgagtcatgtgaccactagaagctacaaagaaaactggcaaatgtggttttctaagcaggaggcctctgaccaggatggaagggagaactggggactcatggttgccatcacaggcaacaagtggcagatacccccgagcagaaaaaaatggaaaaggaagataatgctttacatttgtagagcaatctgcattttatgaagttctgccccataatttattgcattgtattttcatattagttctatacagtgggcagggaagggtttattgtaaggagatgtatataaggagaatgtctctccattaatctaagcatagagactgagaattaactccacgtccaatggagatgagcaggtggccaggcagccaaggaggaaggcctccttttctgatgctcaatctgagaaagagtcatccagaagctaacacacaaaaatacatacatacttacttaaaattcatcaaattagagacatggaaaataaatttaaataattaaactttcaagtaagtttttcaggggaaatgtgtagcattggtatttccgaagttattaaagcctaaatggaactaagactttggggacacaactgaatcacatgagtgttcatctaatacaatttttgccagtttggaaagctcagcaggcttggttttattgttttaataaagttggttggtttgtattttggttttcagttctggcttttgtggaagagggaaggaactagatagcagagtatgctttcatttttattcactaacatggtaccatgataaactaagtttcaaatcctgtatattgtaacaacattataatccatatgatttaaaattttttaagtaatattaacaaagtaacagaaagcaataatttataagttctatgatactaaaactataaaagaatgttgccaaacctgtctcatgtaggaatcaaaactacatgaatttgtgaagcactaaatcttattatacatgattccagtgcttttatttttcatttatttaatatatccctctttctctgctcagaaacagggaattctattctgtgcaattccgtatccctgcatctaataaatactttaaatgttacttatatttagaaaataaagatattagagttttatttatatacaaagcgtttagagcattaaacatttatttttaaatgtctaaagtttttgatattcacttttaatatgatggttaaaaaatgaaaataagagaaacttccctgtctattttttctctttccagatgtgaacctcaagccctacatgacatatgagtacaggatttctgcctggaacagctatgggcgaggactcagcaaagctgtgagagccagaacaaaagaagatgtgcctcaaggagtgagtccccctacgtggaccaaaatagacaatcttgaagatacaattgtcttaaactggagaaaacctatacaatcaaatggtattgagatacctttaaaatacaaataacaaaatcccataaattcataagaaaattgaaatgagtacaatctacatttaattgccctatgcatctaaccactagaaaagtatgttccgataaagggaactgtaattatgtgacaactaatcactcactttgtggtgtagtcctcgtagatttttagcctaaataagtaaaaaaatagaaatgaaagttccttgaatcccagaatatatctgagctgctttcaaaacaagcaaggcatattcagagaaggggaaagagttttaatattgaaagtaaatttgtttcatagtgaaaggaaataaacataaatgactcttatcatttatgtcaagaatccatctcctccataatagtataattaggaactgcttgagacagcaatataataggaaattaaaattaaataaagctatagtattgcatttcttccgaacactaagatttgtaagttgtttgcaaatagttaaaatgatatcacattcaaatgcagtcatttttctgcttcttttaggtcctattatttactacatccttcttcgaaatggaattgaacgttttcggggaacatcactgagcttctctgataaagagggaattcaaccatttcaggaatattcatatcagctgaaagcttgcacggttgctggctgtgccaccagtagcaaggtaagaggagtttgcctaaactctgggaaaaggggttcagtgtgaagattatctgaacatccaggttgtgactgcttttttcattgaagaaaacaatgtccctcctcaaagtggtgttaagtagcgtgttcatgtgtcacgttaactgagtgctaatacctatggctggaaggagagatcatttcaagggagatttatccaaatatcaatcttgtgttaatgaaaaacaagtgaaatcttgaagcagtaccatcttttcttccacattctttcctcaccaaccaattttaggtaatctataaatctataaaaatgtccaaatcattattcagttaaagaaagtttctatttaaatatgatatgaacaaaaattgtctgattttaaaaaatgaagagaagggcaaaaaagcctggcacggaaaacaaaattgttccaagccttctgctatagccttgtcaagaaataatgaagacctgaatttaggcagcagaggtcagaaccgagaatacagaatgatacaacagacatgggggataaaatctacaaaacttggtactcaattatatttacagaaataaaaggaaagagtcacggatattgtcaaatatctgcttgagtaatttgtggatcatggtgctattctgcaagcaaatttttaaaaaagagaaaaatgttgaaggtaaaagaataggattctgttttgttaagttttgtaaaaaatatatttaaagagaaggatcagatagcagggtggcggaagcagatagtacttggcactttatgtgaaaatatctggtcagaaaccagattgagaggtgactgaagtttctagaaagatctgtatgggaagttgaagtaatgagtataaatatggacatggaaggagaatagagagaaacaaatatggaatattgtggatgatgagcactggggaatgctaccaaatgaaaaagaaagaaaagcccacaaagaagactggaaataaacaatcaaacaatgtgggagtaaaataaagaaagggacatttcatagaagccagccttgacagaggaagcccaggaggaaacaaacttacacagagtagctctgattcttttcatatgcttaaaactttagaagagcaacatctttgcacactgtgcaagagccatccaaatgaaacattcagccacactgctcagccacagtgcaagaatgcaacattttgttcaacagacttctggaaacctttctgagtgagccaccatttagatagatagatggcagctgattggcccagtcaaaagttattagtcctagaacaattccatgctttttgcataggcacacttcatgcctgctacatgcaaagcaattgtttacaaagtgaaaaaagttaattctatgaaagaagccaatttttgtccaaaactatgttttgacaatattgactaagtaattgatttatttttttcttctgacttgtttctttctttagaaagttggtgcagacactataaagtcatcctaggtatcatgggaagagtaccgaaatgtctgcccatttattctgttcaaagcatattgtatgcaagcaagttcagatgtggcttttgctccatatttactggtgcttaaaatgtatgaaatcaggctgttaaaatgcaaagacactgatgggccatatggaagagagttatcaagagttctctagtaagacagtctgccagccagattttacttgtttaaacactgagggctgcactctgccgtcaaaattgttgttgaacctgttgtgataaatggtagtgtgagacttatgtaatatattcaaggtcagatttcattgtttaaataggttgggagggaaaaaaatgaaaaaaaagggaaatgcttctccaagcccctgctaatgatatgccaggccagacaacattttaaaacaaaagtgacattctcattgatcaggatagctagtgcactattacaataaattgctgcttaattcctacgtcttcaggtagttgcagctactacccaaggagttccggagagcatcctgccaccaagcatcacagccctaagtgcagtggctctgcatctgagctggagtgtccctgagaaatcaaacggcgtcattaaagagtaccagatcaggcaggttgggaaaggtctcatccacactgacaccactgacaggagacagcatacggtcacaggtgagaaaacaaaaaaaaaggaaatcctactggaggagtctgtcattgtggttaggggggcaaagcatcccaggggtgtgtgtttgatatatgaggtcacttcgaaaggacgtgttctcttgacatatggtcaggtcccacttatccatgctaatagaagagcccacactggcagcaatacgccacaacagcagataacttcagaaataatttatatttggccttgatatgcattatgtgaagggtttttgcatcagtattaactttttttttcaaacaaacagtaagatgcattttcattccccaaggatatactcatagttaatgggactaagatagccaagaatatactggaaggcaggggaaaatcagccagaggttaacatttgtctatcaagtggataattaatacacaggactagttgacagtggagtcattgtgactgtttgttactattaggaatgttaattaatagcaattgtgtttttttaatttattataatgtttattatcattagccttaataatatactattagtacagtacaatgatatgttagataattgctagtagtgattatgataataattaacaggttttagcttaaatgccacttctgaagggaggagaagcattttctgacttacttgctcgaataggttctctaacacaccaccacatcactttgttttatttccatcatagacctctcactgcctgatattttagtgtttgttttttgtctttttatgtctctccacacttgaatgtaggctccaagagagcaggaaccttatctacttgttcagtgttgtacctctagcacttatagtcctgaacacattaataggagctaaataaacgtttggggaagaagggaacttaatatgtgccagacgctgtcctaagcactttgagtgcactatgcaatttgattctccatcaccaacctaagatgtacagtgaattactaccttcattttacagaaaagaatactttgagaagttaagtaatttagttcattattcgagtctactgaatcatcccaaacaaccctgttaagtttaaattctaagaccatgggcaagattgtataaactttcccttttttcccattgtcagccacctccttccaagacttcctgagtggatgacctccttccattggactgcactttttgcagggggtgttgatagcacagataatgaaactcacagaaaagtgcagaaaggccttggaaaaatgtgactgatttttcctaagaagggacacaggttacacttacacagggtggcaaaataaattcatcacttttcactcttaaatgccacaattccctaacacataagcaagcattcattgacaaaatctccagtatttttccaaaagggccgtaaacctgcagaaggtgcttaatacaactcttggcctggcacattgtattccttacctcaagatcctgggctaaatcaatgatgatagtgttgaggctgggtgcggtggctcatgcctgtaatctcagcactttgggacgccgaggcagccggatcacctgaggtcaggagttcgagaccagcctggccaacatggcaaaacctcgtctctactaaaaatacaaaaatcagttgggcatggtggtgtgcatctgtaatcccagctactctggaggctgaggtaggggaatcactccaacctgggcggcagaggttgcagtgagctgagattacaccagtgcactccagcctgggcaacagaacgagactctgtctcaaaaaaaaaaaaaagataatggggttgggagaagccctcatatttgaatgatcaaaattatttcttttatcttattttacttgaagtggaaatcatcacaagtgattgaaataatggtgttttacataataaaaccttacttctatgtggtgctttatcatttaaagaaacgtttgcattttgacttctctgactctcatcacatccttgtaagagatgtttttaataatcatatctgaaagatgaagaagaaagccaacctactcagcgtatccaaggcattcactgcctgtatctgaaaggaaatcagaatatcatttcgttctcccaaaaatgaattgccagcttgcagttttccagatagtacactaagtggtctaaaataagactgctgctcttaagatcctctcacgtacagggaagactgacaagaaaagaaataactgaaaacagagctctatacaggatgcagtggtgaaaaatcaaatgagtcacttggagtaagcaatgggatgttaattacagggttttgaaaagcaagtttaggcacattaagactgtaccagcaaaggtttcacaataattgtgatataaggctaaagaaatttcttcttgtagtatctatcaacttaaccagcatcagcttcgaattgttgctactttattggtttgcattttttagaaatcagcatttatacaccaacagaccaaattcaattgtaatgttcaaaccaacaggattgatagcctcattaattataaaataattgcaaagatttttctctaaataacttcaccctaccagttcttcctttcattgacatttttaatggctatttttatgtcagagtagatttcatacatgtatcttggtgccagaaatcctattattagcataaatattttaaggttttttaatataattttaatttttacttaacagtaaaaaatcataatctggtaaaagcctttaggagtcctttgaccaatctccctgttctacttttgatttgttttaatttctatggatattgttttaaatagatttagagagtatttcacttgcccaatacagccctaaagaggggtttctttgtagaataaagaaataagtcctcattcagcaaaaccttaccaagtacagagcctcctatatgtagttctttggggacaggaatggtgctaggcattagataatcggaaacttgagatctatataatgttactcatttgcccaggaaaattcagttccacggttagctgactgaccaaatgtagtactgaagtattttatggtgtgaatgactgttttattgagttcatggaatgaactaaaataatcaaatttattttctgttccatcttaaatgtttgatggaaatgctgcctgaaccccctaggataaatgttttgattttctcatcatttccaaaagcttggcattccctaagcaacacagcactaataaagctgtagcactagtcgtcctggagcctgaaaatctaggtccttaggaatgacaggagggaaagggagcaccttgcctcggccccattgtctccatgcttatttttaattacctcaaagctttagaaacatgatcccgtaaatgctttgtgggaatagtggcgaatgcactcatcatgtgaaatccataaattgcttataatcctctcaagatgttaaaaaaagcattaagtaattgaagacaggaagtcctcggttaattatttagaggtgttatcaatgctttaagtaaactgaagcgttttctgctatctcactgagctgaataccatggggacgaaggagtagcagccatcatcttctcatattcgctaatgcaaacagcgcatggcagcttgtcaataaaagaccttttcatatcatttattactaaacacatccaccatcctgtacagaacaatttggacatcagttatggcattgtttcactttgggctacctctacattatacgtaggcctcctaatgtgagtttaggaatagaagaaaggattaactaaataattaaggccactgagaaaaaaatgaattagtcatgtcctgtttagcataacgtataataagggcctatgtgtctcttactctggaaaactattttcaaaataattaattagaaattactcatcattgcatttcatttaaaaggaaaaactcaccagcattaaattagcaaggaaagaataatttactttcgtttctcatcttcctagaagttaatgaaaactttgtgtgctaaatagaacaaaccctaacaatgctggttgtagcagaaaatgtaatactaatgttatactgaaacagataccttacacttcaccttggaaaaagagaaaacatactttaaccaccaatacaacaaaatgtagaaattctttgtaagggattttatttttagataactctgctatgtgttcccatattatctttgctctcgtagtaattatcacattttattctaatagcctttcctcttgtctctgttccacacttagtaataggtaatgctttttaagtacagagacagtagcttcctgtttgccattgtgttcctggtacctatcacagtacttaatatattcaaaaaatgtttgtcgaatgaataaatactgaatagtaaactagtatttgactacattctgttttgaatggagataaaaatgccactgtcaaacgtatctaaatcgcagacagatctggcaacaaaattgtggggtccagtgcgaaatgaaaattcaggccccttgttcagaaatcattaaaatttcaagacaatggaagcagagcatagaagtaagctcatgtgcttccaagcatggtaccgtgtttgattgcacagtcgaagcccacaaagccaaccctgatctccagcagtctggaattagctgcagtatatttctttaattaaaacagatagcaagaaaactaggatggtgataatgtcctcaaaaagctttgggagtttcttctatggttgtttgcaatgctccaggctgcattccccccagttactatgtaattactgaccaccaagcactggggacctgtgaaaatagagataagaatttgttttcttttcattttttcaactctgagaacaactaaatttgtgcctgaccaaaaaagtaaaaaaaaaaaagaaaaaaaaaagtgtggcatcaaccacttttttgtgttttaaaacctgcctattgataaaatattaaggccaaagaactataattgatagctgcctagacaatgatattttttaaaattccccttaaatcccagatattccaatgtactttgccagatactagttctgttttgtcactccagttctggccacccccttccctctgcaatgtcctcattgtctcacgtttgagcaacatcagattttgctgccacctgacatcacattttgtttttagagaagaaaagtctgcctggaaatgcagagaagaatcctcagtctagcataacactgaacttgaaagaggaaaagtatttattaaaatatttattaaaatactgtcactaaaatcaaaatatatatatcacagatataattcatattatatttttgttgttatatttattccagatatacatcaacattaagactattatttagacaccaccaaagaaaaagggtctttccttggtggtgtctaaataatagtcttaatgctgatgtatatctaaagagagtctgccaaagaagtaacttgtttaggaaaggcgtcttgggatcaggaagatattggagagaggggcctaagctatggcccagaatttcaaatgaaatatagaattaataacgcaagttagcttatagcaagtagtcagaactaaaagtcatgaagtgatcttactggcatgtgcaatgcaagagtccctttgttttgatgttttgatgttcagttcatatgaggtagcaactgaattcataaagcatgaatacagaaaatggacagtacaaatgctgctcaatgggggggaggaaattggcttgggtaagtggaatgggcagctgttgagattgtgaagaatgataccatccagaaaagatggctttagcatgtgaactcccgaaataatccttaatcaaatcctgtaaaacaaattctaatttaaaggtaccttagatgtctgtaaagtaattccatgatgcctttgtataccagttttgaacatctggattttcacagattgtcagattgatctaagtagaatgctgatatggctctatccatcacagtcaagatcaccaggggatgctggaagttcctgggaatctcagtaggcagagatgctccgaaagggatcacttagtgagatcccaggcaagtgagggcaaaaggaagcaacatcattatagttgtctgggtatatactctggggctcgttgtcttgcgccaagaaagaattcaggacacagacacatgtgggtgtgttaaggagtggaaagtttaatagaagaaaggagagaggagagcagctccttgtgagagagagagagaaagacagagagagagagagagagagacagagagagagagagagagacagagagacagagagacatccgtaaagtggggaggcagcggaccaaagcagattttacaggcaggctggagaaggcagtgtctgatttatatagggctcacagattggttcgatcaagtatgacatttacatagtgggaggggaaggctggtcaccccaccctaatcttattatgcaaatgggccttccagttgattggttccatcttgtctgagccttacagtacaagtggctgacaaggagaagggaagatggagcctccatcttgaacatgtacagtccttagttcctgcccacattcacccatgcaagcacccagcttgtttacctatgtctgcagctcgattttacatgcttgccctttgttagaaaattatttggggctttttactaaaaagaaaaggcttaccgaggactcccatacctttactatctgcctaagtgatttcttcttaactcctgtatcattagcaaggactgaatgtgagcagccgaggggccagaccacacatccagtttgggtgaactggtgccaggacagatgacttacccgcaggatggttattcacaatactttataagcaccaaacaaaaactttttaacgtaactcaggcctctcagtgcttgagctaatcactaaacatgctgatggaggaactcactgaattacacatcctttaggactatttggtaattctttagaacatagcagatgacactatagaataattggctgaatgttttgaagtagcacttgctatgtgaaattataatggctaaagtgcctttttttgactatttatcaagagattaaaaattggaagcaagctgttctttatagagtacatcaaatgttaactttcatagacatgggttttgttttccaaatcatatttttatgaactaaaggcagactttttgcagtcccttttagcacacatttactcttcaaagtaatgttacttggaagtgtaattgtaatgagtttggttatattatgcttctttcctttaaaaaagaacatgattccctgtagggaaattcaggtaatttgcagccacagtaatcttcactatactgaaatgttaaatacttggcttttctccatgtgtttgcctttctgtactctacaagtgctatttcctactcttctaattcaatgctgagcacttgaatgatgttttcttttctccttctactcttcgacttcaggattaagttacagttggaatggttcctttgagacatctctttatttccctcttctcatcctgatcaattcatgagtagttttcaattggtgtgccctttttattgcctgttgctagtatgtcatatatatctcattttaaggactaccgatagaggcttacttaaaatgacagcaaattccagttgaaatgtgttcattttattgagttttacagagtcgtatatatgaaaggtcatcaggttcatgtaaatcatctatgcctgatggtagttgatgctttcttacagattatctgaaccaagcctattagtaatccagtcctctaacaatatgaaaaatataaaaactaaaagatagaatatggttttaaattttctaaattatggatttagatattgccttcccttaaattaatctgtaggcctattaagcagtctctactatcatgcctacagtttatagatatagaaactgaggaacctagaagccagaaaacttccttgtagtctagtacttggtaagtagataagtattagaacccaaatagtctaatttcagactgctctcttagcacagaacatgactcagtatctcactacatgactcataataatattcaaaatgaaaatatttaaatatatagtcccacttgaatttttttttttttttttttttttttttttttttttttttttttttgagacggagtctcgctctgtcgcccaggctggagtgcagtggcgggatctcggctcactgcaagctccgcctcctgggttcacgccattctcctgcctcagcctcccaagtagctgggactgcaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcccggccgaattttttatattactggaaatttgactgggctttgagctatttatgtcatcgtttttgttataaggctgggaagcctaacccagttgctctgggccacatttctcagtgtaattgcccaagttccaaccttggcctcaccctttccttttctttctttctttttttttttaggcagtctagctactatgtcacccaggctggagcatagtggcaggatctcagctcactgcaacctctgcctcccaggttcaagcaattctccagcatcagcctcccaaacagctgggactacaggcatgcaccaccacgcctggctaatttttgtaggtttttttttttttttttttttttttagtagagacggggtttcactatgttggccaggttggtctcaaactcctgacctcaagtgatccacccgcctcgtcctcccaaagtgctgggactagaggcatgagccaccgtaccaccggtcccggccctttcttatgtctgtgatcataggtactttcctccaactttctgtgccttagcttccttatctgtataatgaacaaataatagcgtgcacagcagaaagttagtgtgggcgttaattatattaacacccatgaagtgcacagaagagggccaactagtagtacatgctcaataaacttttgctagtatgtcatttacataatcttataactaacttccttgaaaataactgcaattctcataaaatatatttagataatgtatagagtccaatgaaaagagaattaaaaacagaccaacaaaaacaaaaacaccctgagttttgtctgttgggtattttttttcttaatttatagtttttgtgctggtgtttgaactacattcttttaacttttttttttcgttttgagcaactacagtgtatacaattatgacttgccaattaaaataatattaattttaataaagagcagctgcaatggtttctaccatttttatgtcttctaaatgctgcttaatcttcagagggaaggcagccattgagtaacttaaatactgttagctctagctcttatgtgatggagaacatagagcttggtattcaggcttgggtcatctatgcactcctcagtccaggtgaagtcaacgctaaataaagtacaaagcctgatagtggacaaatgactggcttatccaaggaaaatgtgagttttgttataaaaagcaggaacagaccctggaaggtaaatatggcagatgtgaagttgcttgacacacattagcaaacatcatttgaaatgagcctaagtattactaccctttgcccacatggtccattaaactggtcagcatggctacatttcagggacagacacagctcttgaggataaagtgccaatgaattagagtaaaactgtcattctccccatattcacttgcagacatgtctcccactctcatcctcctggttcttcaatctttgtctcctttcctcagtgcaccatgttgactcctcttgatttgataatatgtttgaactcctctgacttcttgacgaaggttttctgctcagtgctgagtctgccattcctccttgattctagtaccccagtagcttcaagagaagcaaattccttccaccagccctacccccatatcctgctaggtgaacctatcccatctaatgtaaacacctgtagcaaactcctttgatgcactttcctccctctatcaaaaatccttaaggtgctggatgctctactgctgtaccatgcctaaacacctgccttctcaaattctaggctgtaagtaaaatggagaccactcaacttgcagcagaaaggctttgtcaagaaatgacaatttatatttttatatacattaattttcctttcagctacgattctcattacaaatacgcttaatcctctaatcaaccttagcaaacctctgtgattatgaattttcttttttccctaatgcccatcctaaaattttatttaacagtcactgcatgtctgaaatcagaccagccacgaccacaatgaggaagataactgaggccattgttttgctcagaatattcgagaaaaaaatttaaatatctgtttacttttagctaccatatttacatctggcattcaggaaaaaatctagaatatgtgtattgcccacaaattatattagtttctgttattttattaatattctgcaactaaaaaatatctccaactcaatgaaatcattgctgtggacagggataccgatggaattatgaggaaggacctttttggtcaggtcacatggtgataaacatcgtagcctcatatccctgcaatccttatgggacactatgatgggcatgctcttctttaagcaatatttgttcaacattgaatgcctaaaaatgggcactataggggaaagtgacctcccaaaaagactcgctcagtgatgccatttctactctcaaagggcttatattctaaatggggaaaataagatattcaggtaaaatggtatcacactggtcaagacccctttttgtcggtaaagagaatgaaggggagacattgtcgagctaaacgagtttgccactgcaacctctgagtttcattcttgaatgttcccttccattattttgagctttacattttgtaatcatagcattttccgatgagcttttatcaaacatatgtggcttgggtacggcttagatctttagtcatattcttcatctgtaaatcaggtaaatatcaaaattatgtaaatcctccaaagcaaccaaatggaagattgtaatcaaataagtgcctgcatcttatcactaagttgataaaaaaaatacaaagggctctgaagctaaaccttggagcagctccagctgcagaacattattgctttagcagagaacccagactactgctctcattctaaatggatgagatgggtaattttttcattcgtttaacgaacacacactttgtgcctgtcacaatcctaaggatacagataggcaaaacaaagttgttgttctttcagagcatacatctaaagcaggagacaaatatcaaataagcaagagacacagcaaacatcagagacggttgaaggctctgaaataagaaaattatgtgaggggataaaaagggatgggtggattgtttagataaagtggtcaaaattttttaaaatgtagtatttgaggagaaatctgcataaatagacaaagtgacacattaacatctctgaaggaacagtcattccaccaaaagaacaaaatatgcgaaaatgtagctcaaaatacgtgaaaaaataagcataacaatcattggattcatctgtaacttagttcaattatttaacaaataggctcagtcctgttgttttaaaatactatttttttctcaaagagagctttggcattgtttgaactttcccaagagtcaagagagagatgtcttgtaagcctcaatatcctccttgttgaatgctgctgagctttaaagttgcttctgctagaatgaaatactactttgagtatcctatttcatcttctcttgtctgctagatgctataatgattccccattttacagatcagtagaccaaggcaaagagaagctaagtaactctaacaaggtcaccagccacgcacagagcagcgaaatctaacaatatacaacttctattttagatggattgtcattcttttctccctgaaaacttactgaacaattaccatactgcatcatattctgaatacgaaagaagtaataagcaccatctcttctccaaattagctttaatctatgtgtaaagacaaaatcaacacacctcaaaaaagggcgcattagatacagtgcaaggtttaaaaacaaaagtgttggttagcgttaatatgagttgaatatggcttggggcaagaaaatgttggatctaaccttctttttattttcctgcccgtatttatataagaagcaattgcagagactgggatggttagcctggagaagagaagactcaggggggatttgataactgtctacaaacatttgaagagctgtcatgtggaaaagaaattagatttgttctatatgtccccaggggtgaaagtgatagaaagatttcatcacaatataaggaaggactttcaaacaaaataaggataactctaaggctctctaaagatgtaatgggctctttgagagacggagtgctctgatccgataggcaggacagccttttcaatgacatcttgtatagggaatcaagagaagggtggatggttcacatgaattttaaggtcttttctatggctgagaatttattagtttatcagtgataaatgaaattttgcccaatacttagcctcttatgaggttcagaccttctttaaagagtgttttagagagtactcttaaatgttttggctatcatatctacaactctgcatgttacttctggtacttaattgataataaataatcctcttaaggtgcactttatttcttgcttgctttttctaggtctccagccatacaccaactacagcttcactcttacagcttgtacatctgctgggtgcacttcaagcgagccttttctaggtcagacactgcaggcagctcctgaaggtaatgaaacaatatccatggtttgagggaagaaattttcacatagcattttgaggtggaatctgtaaactccttcataacaaataaggaagaggcaataaagttgataggtacaaaataaaatagcattctaggttcccattcttcaggcttgattcatgtaggtgtagcttcccaaggtcagttcgctttcaattctttaacctttatagagttgattttctgtggaaagaagaattattgaaatttttcaaaaactcagatgttaaatattttgggagcatctaatatataataagcaccatgctcactgctgaagttgtttaaaatgttctctgccctcaagactgacaatcaagtagaagtgataggagaaagatctgtatgaagagagaaaatctgaaagttgatgttaagaaagaacaaatgaatagagtgctaaggttggcctgaagaggaagagatagaaacccatcgatgacatcaaaaaaggctttatggagcagatgacttctgagatggaccacaacaaacaaggattttgacaaatgaacagtgatgtacagagatgtacaaccagacacagttggaaggaatgtaagatggaatcatcaccttagaaggcaaattgcaaatgtctatcacatttaaattgttaatttcccatgatacagctgttctattttcatcatttatgccagaaactgtgccacactgctcaaggaggcatgcaccaggatgtttattgaagcatttattttgtttaatagcaaaatgttgggagcaattttaatgtttgtgagtagaattgctaaataaattcagctattctcatattgtggaattccatgcaccagtataaaagaatgagatgatcagttcatacaaagaggaagttatgacattatattaatttataagaacaaactgagaaaatggcatttattgttaatggttaataaataaatgcatttaaaaatccaggaagtatacacaccaactgatagcaatggttacccatgtgttcagaggtgggatggctggtgtcatttactttcaaaagaaaaatatactcagtggcatgtgttagtgatcaactaattattttgttaatcttcattatctgcctatttttcatatggggaaaccaaggcataaataagtttctaaacagaaatgcaatgttaattaccaccatagactcctgaactacttgtccattactcttctaatgaaatggattgttgtacctcggaatattagacctgaacttcctaccagtaaatggggaataaaatggaaaattccacatatggggcatatggctcctcaccaggaattcactaatgatgttttctatataaagaatgtttcatgtcaaaaagcttagtgttcctttgaaaggaagaaaccagcagtggattttttggaaaggtaaactatcaaatggatactttgatgataatggataatttctaaaggatctatcaaccagatttggctgaaactcaacctgataaaataacagaatctcttgttccatttctctctaccaaattcatatatttaaattcattggaaatatgaaattttcccaacaaaatttcttgaaatgacttacattttatgacttaaaaattgtagctttcaacagtgcagggtaatgtgatatgagaaatgcccttgatttcttttttttttttaactttatgtatctttcctctaacacaaataatcatgcaaagaaataatagatgaaatggactttcctctgcagaagaaacatggatttagggccattttctggctgaataagtgccatttatatataacccatatatgaaataaatatagtgtgaatgcttaacttgggaacaccttagcaatcacattaagttctgttgttttactgtaaagtgaaaacaagtataccactttagattatccacccagacataactaattataaaatgccattttcgaagtacatcagatataatttgaagatctcatatttgagtattttaagtggacatggaaagaattaaaagaagtgtttatgcatagccaacgcaagctgagctcttttcacttgcctctcattttcaatctaagaaaaagtcaatgtacattacaacctcattgacaagttggacacagttctctacagttttatcctcatagaaaactgtgtacctgtacctttagtcaaataacaggaagattttgaattgaattattactctttttttctacaattactgccatccatgtgagttctaattcattttagagataaatcatgcaaaattgcagacatactttcctctagcattgataatgtggaaacagaaaggaaaagaagacccagtctttttcagttcattccagattcctcttcctctgcccttcttttaacgtttacacacccttggttttttcctctactctttacactatagcacccaggctcttctggaattttcgagtactggctttatctcctaatgaaggctgagagctaccaaatactaaagctctcaccaaagctacacttatggatttaaatcctatgtatttactggtctactacatgtttatatttaggtgtttttcaaaaactttaacctcagtacttcgccacttaattcttccactccactctactcctcaacttgcttttcttctctcaaatactaccacctacctatcacctaagcccaaagcttgacactcttgatggctcccttttccatatgtaatacataattttttataaaatctaattagttttaaatcttaagaattttttttaaaaaaattgttcttctttcccgtcccttttaacactgccttagttcagatcctcatagctataagaagagaagttctctggatcctcctaactaggatcccttcctctagtcatttttcctctttctcacatcccacatcctgattctttttcctcttttgacaaaataagaatatgtcatattattcacctccataaagtcccatttccttccaggaagacatacatccatatctccttagcaaagcaacatggacccctcaagttttaacttccatcaatttttcaaggctttccatcttccccacatgccatgcagtgcaccagccatgccaaggtatgtgcagtcctgccatccttgcccacatttctacgactttatgtgggttcccctcagcctgaactccctttccctacatcctcactcagttaacgctcaccttttcaaaacttggttcacgcatctccccttctggaaatcttccactacaaccacctacttcctacccatctccacttctccccacagtctgtgtcaggttaccctttctaagtgttctaacagctactgtgcctccttctcttaaagcatgtatcatactggagtacaactttttatcgactcatctttattcaccatgatacatgaactccatgaaggataagaaaaagtctttatcttcccatccacagtgcccaacacagaaaatgacacaaagtcgggtagaatgttgagtgaataaattaacaaatactaaattgtccagaattcagtgcatccctgacatcagctaatacaaaatttgttcctatcaccagatttcaggagaaaaacaatccacaataaatgctgggaattttgaattggaatgaagatttgtagggacatgagaagtgggtaatatggcatgcaactcaagataaatttaaaacaaatacagtagacatgttctacttgttgtcactgtgtaaaaaggcccaccaaggtttaattctacctttccccttttaaccttgcagctagtttaccccaccccatcctcctaggttacttccctccctactattcatttctttcacttgaactgcctcagtttgctcccttattatatagaataggtttttctggtttcacctgagacttaggccagagttacatggtgaaggggacaaattccccacctcggactcattaatatatctcaccaaagattgtcttactctagcaaagatttcttgcagctgccaagataacgatgtccccatatcaccatccaagtaaaaatgcagcactttctagttatatatacatttgaactccatattatcaatcaaaccaatgggcatggagttattaccaacttgaaaagagcttttgccagccggtataaataataaactcaacttttacctaaaggttgaaacaaacccaaaattatgtttcattttattttattagctcctccacatccacaggctttattgactggttcaaatcagaaaccaagcaatagccattctagtaccttggtgatttttaatacatcgttcaaggtgaaaaagatataactgcaggaagcagattatgaattaagattttatactttatcttttgaatcaacaaattaatatcacatttaaatcaaaactctgattggttgaatcatctagcagctgttggcagagaaacccacatacaaatgtgtactatgatttgtgaattttaccaaatatctagaacagagcagactctcagaacaaaatgaactactttcttctcaggaatatattgctccttagaaagttgggatgtttgagacatttttgaaatctatcttgtttctttcaggatgctgctaaataaattgcattttgttcttctgaaaatttttcttctaaaagtgtcaaaatcttaacctgtacggagtaacttacacaggagatacaatcaagcaaaagctattgattacagggaacctaatattgaaatgagttttttttaatctccagaagagatttacagtgtctaatcagagtataactagatgacaacataaagtggtaggactgaactttctcactgctggcttctccatcgatggatttgtacatctataagagtacttgaatgtttgacattgaattacagttgtttgtgtgtatattttattttttagacagaagtataaactccttgaaagtgagccacatcttagtcatctttgcattccctagaactgcctgcagtgcttagcataacattttgcaggagatatatttacaataaatctactcattaaacatgtattaggcattgtgttatccatagagatacattgacgaataagacagagaagatccctgctaccatggaactaactttgcatcaaagtaagagaaaggagaggactgcaccatcatataatgtaaaaataatagtatgtcaaagaaagaatttgattatgatgtcttgagtgttaagaaggaaatagaaaaggccatgcgatacagagaaactaggttgggactccattagatggggttcaagttagagttaagagagtgctaaaatgaggccttatcaataaggtgatagttacacaagtaactgaactatgagaacatatgagaacattctacatataagaacaattctacatatgagaacaaaatgcaaaaatgtcatgctgtaagggaacaaaggtgttccaggccaaaggaaccgaagttcaaaagcccaggtgtaggaaataactagaagcattctagggatagaaaggaatctggtatggccacagctctgtgaatggtgcaaagaatgctgccacttaggccagagccaataaaatgtgggaccatatgggtcacaaaaagaaattgggattatattatatgaataaattcaaaagggttatatggttcataaagatgacactggcttacatattcactttatacacttttacaaagattccaatggaatatggaaggccaagatttcgacatggaggcaagtttagaagctatgacaggagtttatgagagagagaaacgtggcttggaccaggagaagtgaaagtaaagatacaggaaagtatacattatagaatcttctgggctttatgttagattacatttgggcgtatgaaaggtgaaagtctcagggatcattatttttgtgtgttttgtccaagaaaatggatagatggacaagattgggaggtacatagattgtagacaggaaaaacaagagttctgttttgcatgtttttagtttttgatatatcatcagtcatccaaatggaggtgtcaagcaaacagttggattcttgagtctcacactcagagtttcaatctagagatatgcctttgggggtcttcagcatatgcatatttaaaacccatactgaatgaagatcacctgggaagccggtgttggaagagaagagaagagagaaaaagaagaagagaaaggaagagagaaaagcagaggggagagagagaacagagcatactgctctgaggcattacatcctttcaaggtccaggaggggaagagatcccagtaaatgaggccagaggcatagccagagaggaaaagagaagcatcacactgatgtgcaagaagaagggaaagtgcactcatttgttgaattgtataattcaggtacatactcgattatgcttactttcacatattccaggtaaattgtattaaaaagtttgaaatccccagatgatctctcaggccttgatttaaaatactctcagagtgacaaccaaggcagagaaattatccactgctagttgtctgacattcactttccaaaggcaattcaaaaataaaataatcaaagtaataaaaatatatttacaccaattatgtatttttgttccatacagttagatattttttaaaatcaacagaaaaaatatcacagttcatgggggggatggtgtgacttttgatacactgtttattttctcctaacaataaaacctcattgcgttattcttgccaggagtttgggtgacacctcgacacattatcatcaattctacaacagtggaattatattggagtctgccagaaaagcccaatggcctcgtttctcaatatcaattgagtcgtaatggaaacttgcttttcctgggtggcagtgaggagcagaatttcactgataaaaacctggagcccaatagcaggtaaactaaaagaaaactttaccaatcatacagcaggatttgtacatttctctgggttgataagaaatgcatgtcccactgaaagttgttaaattgtttaattaacttcctcattcattggccattcaataactgatgaaagtgctaaatcattcagtctttagacttcacgaaatttcttaaaaatataaataattcgtcttctgtttgacataaaagcatgagaatttttaaatatacaaaatacatgaagtattaaactttaaaaattaccaaattatcttcaaaaacacgcatccttgaactagcaataaaagagatgtaaagagttttgttttccgtcaactctcttttcttcttgtacagtgtttctctacttgctacaccacatatagttgtgaatagttttagaggaaaaagttccacatatttgcatttcattcccattcatttctcagcagagacaaaaacatatcttaaatcaacagatgttttactgtagaaagtagagatcaatttcattttattgtaaggaatagcagatcaatttaaaaacatctttctctaaacatatttccctgaactccaacctatttaaaaatggggaagattaatttgaatcctccacaatccaccagcacactccaagactttcctgaaatcttcaagaaaagctatgaattactagcaggttaaaaataaatttaagagcagctgaaattacaatggcttggagacaatgttgcctgtgcaagaaaaactaccaagtcaagtttctggaaagggggcaaagagtttgcaatttgtcacaaatttaggactaagcaattgatacaaaaactagtaatcattgttcaagtctcttgtgcatggccttaccacaattcttctttctttttaaatatagatacacttacaagttagaagtcaaaactggaggtggcagcagtgctagtgatgattacattgttcaaacacctatgtcaacaccagaagaaatctatcctccatataatatcacagtaattgggccttattctatatttgtagcttggataccaccaggtaaaaaaaaaaaagaagtatgtgtgtgtgtgtgtaaacattttaaaggaattaattagagataagaatagaactgttaatttagtaaatcagaaagacatagtcggtctcctggataaatatgaacagaaaaatctaaaccacacttctaagtgtatagacgcatgagtacatacatacatacgtagagatataggtatctagatgtcgatgtagatatgtaagtatatacagctttctatgaaagcaacactttcaagtacaagagactaaaaatctttttactcatctattttttttttttttttgagacggagtttcactcttgttgcccaggctggggtgcaatggcgcaatctcagctcaccacaacctccgactcctgggttcaaacaaatctcctgcctcaggctcctgagtagctgggattacaagcatatgccaccatgcccggctaattttgtattgtttttagtagagacagtgtttctccatgttggtcaggctggtctcgaactccagacctcaggtaattcacccgcctcagcctcccaaagtgctgggattacaggcatgagccaccacgcccggcttactcttctatatatccaatgcaagtcatataggtcagaattaccttgaacattcatttccatgggactccttagattggatcattgacattataccattccttttatattaaatcagtgaatggggagtttggaaagacagttgttcacttcacccatgtaccttgggttgtgaccacttatggtagctgcatttttcctctgtaagctgaatagccttcattgagccatttagtcattattgggttgccttgtgacttagtgcaacattatattttgaggtaagcaccatcctcaggtaaaatcctgactgcattaatactgtggagtaaagagtagagtgagaaaggacatatggaggacttttctttccaagtaaaatttaaaaatggttaagatgttaaaaacacttcaaaattatgtgactttatttttaatatctagtcttaagatgaaattgtgacacgccctttttgtcgccatcagaataagtttagccacagttcaaagtggcaccaaatggttaacagccatttgagccatcggtagatccattccataacataattaacataagcctatttttattgaattgaacagtcaaaacaggtactattgtatagctataaagagagcgtaaagacctaatacataaaacttaagtttcttatagaccaacaccttctgctataatctaagatcaaagagaaaaagttattttcccctaaaattcaaaagaaagtttacaaagagctttataagcaaagaaaaatataagttgctctaagatattaaatgtacatgatttcacccacttttgtttaaaataaatgtgcagcatattaaacaaaatataaaggaataattagtagtggcagaatgcatcacaaagtgctataatctttatgttgtaagagcatagatattcttgaactctgttcttaatttcgatagaggaaaagacatatcttctgctgtgggaaatatataaatttacagccccctttacagaatttatttctacttttgtttaattttatttatttatttatttatttatttgtttgtttgtttgtttgtttattttgagaccgggtctctctctctgtcacccaggctggagtgcagtggtgcaatctcagctcacagcaacctccgcctcccaggttcaagcctcagcctccaaagtagctgggactacaggcacacaccaccatgcctggctaatttttgtatttttagtagaaatggggcttcaccatgctggccaggctcgtctcgaactcctgacttcatgatccgcccaccttggcctcccaaagtgctgggattacgggcatgagccactgcacctggccacgattttttagtatatttctccttggcatttttattgtgctgttgtgtttttgcaccacaaaataaaatgaagctggatagagccaatctaataccatatttagcctattgacaagaaagttttagatttagaccagggtcttctacaatccaaattctccaagagcaatacgggaaatttcagggtgatgagcaaggttgatgatttctttgccatatgactgggaagtcccatggtttatcaaaatatctgttattttaacattatttaacatatcagttgccattgctaatctgaagacttcatgttcagtacgaatttgaaaatatctttattttatgactatgcaagtaagagaaatgaaaaagcctggattcatatcccaatactgccacctattagctgaacttaaacggtctctaggcctcaattttctccatctgtgaagtggagataatgatgatacctacatgtaggcaggtagggttgctgtaaagatcaaatgaagtaatttatatgataaatatattatctagttctatataatattctatagataccaatggtgattgtttgaagaattatttttttatctttaattgctcatttttaaaacgtatttgttccaacatttgctgggtctcaaagccccaattttcaaaataataaaaccacctactgaggattggattagtaaattttcaagacctctttcaaatttcccagcgtgtcatttttttctttgaattcaatatcacacttaaatgtttaatgtatcatgtttccatttagaaatgtatcattgtggaataaaacacaactttcacttgtttaatatgaccttaactctcacatacctcaggctttgtataaattgttcattctggtccagcctaggggatattgtagaatgctttacacactaactctgaccatttaaccaatggttaataaatctataatattcagacctgtcaatcttatagtttaagatgcacagaatccatttcagaaaccatataatataaggaaagattaaaatcttcaattaaatctttttcctggtgtctagaaggatttcaaactcagtaaacagtcagatgattttgacttgtgtataatctacagttgattttattggaaagtacctcatgctgtgttttgatttggataataaaaacatgtttctattcctgaatagtcacaaatatatatattttaaacagaaagaaaataaatttgtaagtggagattgtttatttgctcacaatataaagagttttctaggtattcatcatactccctgccattacaaaatgactacatcacagacagagctgaataatgggcaaaacagtccatgcctgcagttcccaaacctgaatgagcattagaatcacctaggaagcttgtgtaaagacagattctcaaccccaaatttactgaataagaatctcctgggatggagtcaagaaatctagagctttttaaaaactccacatatgactttgatgtgctaccaagtgtttttgaaatagtagcccagaggaccaaggaacagatctaggtattgctgaaaccaaatgattctgggagaacaatgtttgactgggtgtgtagtggcgtgccaagactagaagagttaattgtggaaaatggcaagccgctgaagggaaaacagccacgtgacagcaatgatctctgcagcatgaagaaactagtaactagaaagctttacctacccatccaaaaatctaaaaggaatagatgtgatttaccaaaaacatggatcacactcaccaagtgagactggtgaattacaataactgttttctctgaaaacatgagtccgccagtttctcttgaatgtctaaagcaagcttatccaacctaaagcccaggatggctttgaatgccacccaacataaattcaaaaactttcttgggatctttgcaattatttgttttagctcatcagctattgttagtgttagtgtgttttatatgtggcccaagacaattaatcttctttcattgtggcccagggaagccaaaagattggacactcatggtctaaagccaaaatactggctaaattgtatttgtttttttaaatatgcatttttttttttgtggtcagtgtgaacagagtaaccttagacaggtaagctgctgggaaaaaaaatgtctatgtggttacttggcaactgaaaaattacctaagcaattaactgaattttcagttttcaaactattgttctaatgctataaataaactaagccttagtacatgtttataagtcctactagtgaaagggtaaggtctagggaatagtgacaatacccaggggaagagtacccgtgatactgataacaaatgtcgtgtacatacgttcatattacttggtgtatttgccatttgttaaattcctactatatgccaaacactgataagctccttctctgccttacctcagttaatttttatgcaaacgctagaagacaggtaataatatcattatccccatcttaagataagaaattcgaatctcaaaaaagtaatataatatgctcaaggtcacactgcagagccaggattcaaattcaggtctactgtctgctactgccttttaagaccagttcctttctgtctttggcttaacccttaaatccaaatcgacttttcatttcttgaccaaagtctctcagatttatgatggatcaactatgatgtttgaaatagtagcccagagggccaagaaacagagctgggtgttggtgaaaaccaaatgattctgggagaatatttttttttaattttttttcttttattatactttaagttttagggtacatgtgcacaacgtgcaggtttgttacatatgtatacatgtgccatgttggtgtgctgcacccattaactcgtcatttaacattaggtatatctcctaatgctatccctcccctctcccccaaccccacaacaggccccggtatgtgatgttccccttcctgtgtccatgtgttctcattgttcaattcccacctatgagtgagaacatgtggtgtttggttttttgtccttgtgatagtttgccgagaatgatggtttccaccttcatctgtgtccccacaaaggacatgaactcatcattttttatggctgcatagtattccatggtgtatatgtgccacattttcttaatcctgtctatcattgttggacatttgggttggttccaagtctttgctattgtgaatagtgccgcaataaacatacatgtgcgtgtgtctttatagcagcatgatttataatcctttgggtatatacccagtaatgggatggctgggtcaaatggtatttctagttcaagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgacttgcatttctctgatggccagtgatggtgagcattttttcatgtgtcttttggctgcataaatgtcttcttttgagaagtgtctgttcatatccttctcccactttttgatggggctgtttgtttttttcttgtaaatttgtttgagttcattgtagattctagatattagccctttgtcagatgagtagaatgcaaaaattttcttccattctgtaggttgcctgttcactctgatggtagtttcttttgcagtgcagaagctctttagtttaattagatcccatttgtcaattttacctaggcaataccattcaggacataggtatgggcaaggacttcatgtctaaaacaccaaaagcaatgggagaataatattttactgggggcatcaaaaccagaagaattatttgtggaagtggtgagcccctgaagggaaaatatccacattgcaacaatgactttttgcagcgtgaaggaagtagtaaccagaaagctttacctacacattctagaaggaatagacgtgacttaaaaccagattccaggtgtaggaagattttagttaggtgggaggggaggagagtcacttctcaaattgctgtaaagagatcatccaaattctattttaaagccttggtaaatattcccctgtctcccatgtaaaccttcatccactttaccttattctttcttgataaatgtcagtagtaacattaccaaaacactctaagctctagaaaatcaagatctctagccttttgtgtatcatttgaacctctaaatcaggtgacatacaaacaacatatccttataaaaattttgctgaattaatggaggaacacaatggtgagcgagcctccacaatttattatgcagtcaaatgtaaattgtggatatcctgccatttaaaattactcaaacatttgattttctcttaaagtcatccttcgtctacattaacttaatcttaaacagagacatacacacaaagagagagagaggcagagagacagagagagagagacatttcttctttaatgacaaacagagcacatacacatattttccaaagactgcatcttgtcttatggatgtgcaattttttcacctttcagaaaaggtggtattgttttctaacatggaatgggcttcactatttagttgtcctctggccttgggcaagctgcacaatgtttctcaaattcaggtttctcatctgtacaaggagaaattaaatgcctaccttatattgttatatgaagtaaatgagatggcatggtaaaactccattattgtttgaacctttaggtaatgtaaacaaccttagattattcctaagcattccctctcaccttttaccagctctcaacattgggtcaggacttttgtattcatattaaagagaacatttatattaaagagagcaaaggatatatgttaccttaataggtgaaaaattatggaaaattaaatagcaaatgcttcatggaacataagtggtttactcagaatgacaatggagatagatatccctgctgtttaagaatctaaacattcaaaattatttaaactctgaaggtaataatgagtctttctaatttatcgagatgatgactatattttgaactgttctagcccttaatcatgttctaattaacaatgccattgcatttaacacatactttttctcactaaggatggtgagtcatttaggtttaacgtacaatatagaaatactggtgcttttcctttaacattaatatcttactccattaaagaaggaattagcaagaattctactgataaataatttttattaatattgctctagaaatacaaatttttttatttatcattttgattaaaggttagctggccataatatggtctatttatggacattagacatcttggcattcagttaactcatcagctgcagtgtattatttcagatactatgcatttaaagtcaaaatttacattaatctttctaaaggattcacattacattaattgggatgattcaacattgacagttgtttcacttttcttaacttataaatgcaataaccaaatgacaaggagtggtgagtttcagaagaaaatgtgaaactcacttcagtggtttgtattttattttggatattttaaaatgtatctttcattactgagctttaatatatgctaggcattttgctaagagattaacatatatctcatttagtgttcataataacttaatatagtatgtcctattgttttgctcattttactaatgaaaaaggtcaatttagacactccaagctattttctctaggttattcttcaagcaggtgtcagagcagggctgaccctcatgggtgtgagtccaagtctgactcaaaactactattctatattttctcaatatttttccacctaaacgtgcggaaagcaaatgatttttcatgagttctactgtaatcccatttaaaagctaaaaaactgatttttgctttatatataggaagtatgaatgaggacaatgtaattcaggatcagtcgacccagtaacccaatagaataattttatttgtggctcaaaacttcatgagatgtaattcatttgcctttgggtatattgattcctctagtcatttaactaacgtggaaattatttctgagccccactcaggggcaaaacatgatgctggacaccctaaaagttacaaagaggaatgagacactgtccctcttgtcaggaaccctaccatctagtaaggtagaaaagacataaatgataactattatacaaccaatgttaaatttccatacaattggtatgaatgagttcaagagggtcccgttttacttctgttcccccaaaaaggcctaatcaaggtttccctacctatacagtggagaatttagctcgatttgttaaaagcaccatgttaagtgcaaccaagtgttttgaaacaaatgcctctatcaaaccgaattaatagtttttcctcttagaatttttcctgttccagctcctaaaaaaagacttaaaaaggattattgattgacttgtcccattgtaaagtatgcacctgctgtgaaatgaagccatggagaaaaatagttgaataatttaacttttttatttgtaaagataatcagggtttttctgattacatcttaacttcataaatgttaaataacctatcagcatctagttgttgtaaattatgaaaaggagcattgcaaggaatattaaccaacgaaatccttgttctttagtgaacaagaaaatgtgttatggcagcttgtcattgtgcgactggtaactttgacaccaaataacaaaactgccatttgcacttagggtaaattggttcacttgagcttccactgctcctcttgctctgacataaatttatgaactcaggaactaaccaagtcgtgtggcttcccagctgactttaacaaatatgcccatttcatttcatttagtcatcagaataccagggggctcagtcatttcagactcattgcagatggtatagggtttgtaggaacaccagagactttcgtgtcacagtcctggaaattatgatagtggagggggcccactttcctaaatgcatgccagtgttttacgtgttcacagcttagaggagcattttctgtttcagcacctcataggtatatgtaaaggacatttatttccaattaatgaagaggtgaaaaatacattttctatgctcatggtttggctagccatgtttaaatctggattaagattatgtttatatttgacatgcggtagaagcacagttttgttccttcatcctctgggagtcctgtcctttttataacagaagttacttcttgaaggatgcaaggcctggaagcagaacagtaggtacagactgaagacataaagtaaaacaacctcagatgaattggagggaacgccactccaaattactgctaacaatgaataatacagtattttcgtaggaatgcaatttgatcatatccaagtacacataaaaaataaaactagataacaaaatagtgttacaaagacattaacttgaatgaatgtaacatttatttgtagttggaatagcaactttatatgaaagatggattcaaaagtgtttgagggcacatggaaacagtgccatagttgttttttgttctttatttcattttgttccattttgtcttgtagagatgtcagccatttattaagtactttctatgttatgggaatatattgaaaggcttacagatattttctaatttaatcctcacaactctctatgaggtagctattagtatcatcattttacacatgaagagacaacatccatagaggttagttaatttgccagtggtcgcttgggaaataagggcagcagaaggatttgatctatctgacaccactctgtggtttgtctagttcaacaagaatgatggcatgtttcttatgaatgtgtgtctgtcaaacttttctgcaagaactgtcctaggaacaaagaagacaggatgaatatgcaatcccaggaggtctgaaaacagagcctgaagcaatcatcattagcttgcagtttctttaaggtcttgctttttatcttaaaaattcatgtaaatttgccattgtattccagtgtttgtcttcatccaaaaaataatatattatacaacttatcatttgggaaaacattttctactaatctcattggctaaagagtgataatgctgttatatttcatgatattaggaagatctaaagaaaactaagcccaataacaggttcaaggtcccggcaattcttcccctcttcattttgtcataaatatgtgggttcaccgtgaggcagaggttgcagtgaaccaagatcatgccactgcactccagcctggtggcaaagcaagacttcgtctcaaaaacaaaacaaaacttgggaggccgaggcgggtggatcatgaggtcaggagatccagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaccaaacaaacaaacaaacaaaaaaaaacaaaaaacctgtggcttcaaacaacagccttttattcctcactgctttactgttatggcagggtaacaatagggagaaatgcccaaaatgtgatatggaatgctttgtcattctaggatactctggatggaaatttctatcagcatatcctcctgctgaaggtcaaattgcaaactgagagggtccccgattccttcttcaatctctcttaccacctcaagcaacaccctccaaaaaatactttttgcggagaggaagaagaaacctgattatattactttttattttacctctggcacagtacttaaatttttctcatccattaatgaactgagtctcaaatggtctctataatcaattctccttatccagctctcaaatttcattttaattattgcagtcttgttgagagcagtaaaaactgccagttttgtcgtggagtggtgaattaggcctcgaagaatagcctttaaataggcctattatgtgtattcaccataccagtaaagagaaaaataaagttattttttaggcatttaatttttgttatgatatcttttcctgtttctttatggagaaaaatagtatagaactctttattacctgaaacaaagtggaagtgtcatgggtcaggccaacttttcatcccatgtctagggtagaaaatccacattgagttcactttaaagcaatagcgagagactaacattacattgtcctttggttacagtatgaacagttatacttgttcagcacactggcacatcagcataaacattttcttgtgtcctacagttggttcattctgtggtgactacagagtcttcaactctacaattggctagcaaaaattctaatcactcaccatacatacaattctctaatcttgaacttttagaaagaaaaattcacacccaatttttgtgaacaaagaaacggggattctgctggttccccttcctcaaacagggaaatcctgtgtttcccaaattttccatatcaaagtgatactccaaaaaaaggcacagtaagtccttaaggtcatgataggttcttggaaactgcaattttgagtcaaaagatatataaggaaaccaattttaccttaggctagttgatataagcaagatttaagttgcaaggaatatttgtggtcacaaaaacgtcaccaaactaaatatcatcaaagaaagaccaaaacacttctaatattaaactgaaataaatatgagctatacatacatttaagaaagattaatagaaacaagtaagatcatttttaacctaagttttggcaagtcagcgagtgacaacagccatagggataaatgtttttgagcagaaattagaagaaattcttcttaccaccatgcactagtaaaaacaatcgcaagtagggcaagctcacagaaggcttttgtacagcattatttattattatgcatctatatgatagtaacacacttaatgaatctttactttacaattattcattcattcattcattttctgacacaccttttccagttcagggttggggtggccagggcctaaccaggcagctcaagaccattccgttacagggcacacacacacacccacactcgctcagactaggaccattcagacacaccaattaatttaatggaaacatctttaggatatgggaaaaatccagagtacccataaagaaaccacgcagacatggggagaatgtgtaaatttcacatagacagtggctccagctgggaatcaatttttttcctcataaatattaatgaaacaatgttgaatgaaacaacattattcgaggacctacggtactatgtttgttcctgtctttgaatatactttgacatgagcccacaaacctccaaagcaggtgtatttcaggttgggatacttggtctgcagaactttaaatttctacctataatatgcttgttccatcagtaatgatttttacttatccatcatttgtttccttgcttcggaatagtctccaagaatggctctgccttactgcacaaattttctcaaacctatcttgtcatttttccccaagttgtcctactctaagactccattatcaaggaaaagcataagtatattgatataagtgttgatatcagatgggcctaagttcaagtccttgcttctccaattaatcagtgtgcaatctggaacaagttatttaacttctctgagttttagttttctcatcttaaaaaatagtaatatttaccatgcagtattgtcttgagggttcgttcattcattcaatcagctaacatttattgagctgctactttgtgctaaagtctaggcagtggaaccacattggagaaaacaaagtcctaatttatacggttgacattctagtagtattaaatgggataatgcgtgttgcctggcataacacagggatgcattgaaatgactcttgtttgtactacttctgcaaacattgtaagactttcaaactggtttccctatgtcttgtctctcatgtttttaagccactattcatttcccaacagtgttatcattctaaaatataggtagactcttattttcttatttatacctgcaaagtctccttgttgctgattatatatgaagcccaaatttctcaaagaattaattgataaaatttagtagtcacttgagttttggagtgaagaaggcaggatccactctaaaagtcttactctaagatttccatcctaggaaaatgggaagatggtattatgacttactgaaagaggaaacctaggaaaaagaacaggtttgggagtggaaaatacagctagttctgttttagaattgttgagatcgtggcctctgaggaatatccatgtagaaatacctagcaggctgttgaaaatacaaagctgtaataccggaaagatagaaagctagagataagagtttaggaatcaatgatagaatgttagtagtttaacctactagaataaatgtaccagatagtttagccatgatgctctaaatttaaaataaacattctcagtctaagctgccaaatttaacgcaatctagcacctttcctgaggaagcaattgatcagtacttctgaagatgatcaatatctccttcagacacctctttttcatctatcctacacaaaatcctgagcatctttggtttgtaccagctcttccactctgtaaatacagaggccacatctataaaaagcaaaaccacatttcattctttagacctcatctctcttaggtcattgagtcctgtgcttcctcagtaatgttatctctagattccactgtttctaaagtaaagatagacttatgtgggtactacagaagtaaataactaaactcataaatgttaaaaactctcagatcaaggagacaatgtaatagaaaatgccattatattcttcattcaaaactcatatcctctccttgaaaaagtatgcctgttgttcatgaccaaataaaacttaacaagcatttaattatataaatagactttgacgaggctaaactgacaagacctactttctttaggaaggaatggtgaaaaatgacaattgttgaacccaaattttcgctgtatttagggccataagtctcactgacagtgaactgtcctggcccaataattaatgcactgggaattctctaggtagaccatgatttggatatttcatgggctatgtcaaggatccatgtcagacaggaggcatacacaatgctctacagaaaaattattgtcacaagcaaaattggtgttgttttctatgaactttaaaagtaagtaaacctagaaaaaatataggacagcataattgccttatatgttttaagtgaaatgtgccttcatttttatttgccaatagagtatatctttaaatagaaatattatgcttttaaaaatagattatgtacatttcttacttttggaatacacaatctaatatttgccaacttaacttttgtgaagcttttaattgctatattaaaaagtaatttacttttctattacaactttttttttttttttggaggcggagtctcactctgtcgcccaggctggagtgcagtggcgtgatctcagctcactgcaacctctgcctcccgggttcaagcgattctcctgcctcagcctcccgagtagctgggattacaggcacacaccactatgcccggctaatttctgtatttttacagggtttcaccatgttggccaggatggtctccatctcctgaccttgtgatcagcccacctcaacctcccaaagtgctgggattacaggcatgagccaccacgcccggcctcaattacaaaattttaaatagacattatttttaaaagacaaacatttgttgcccattctgttttatttatatatatatgtgtgtctatatatatttatttatatatatatgtgtgtctatatatatatacacacacacacacacacacacacacacacatatatatatatatatgtttttaatgttctctctctctctctctctttaaagggatcctcatccccgaaattcctgtggagtacaatgtcttactcaatgatggaagtgtaacacctctggccttctccgttggtcatcatcaatccacccttctggaaaatttgactccattcacacagtatgagataaggatacaagcatgtcaaaatggtgaaagtctttcagacacttggcctgggcttttatgaaaaagtatttcattaaaaaatttcattaaaaaggaatacattctcagtccaaatataaagactaacgtttcacttcttatttgtagtggactgtttacccagaaaaatcacagtctggcatcgagtaaagcattatgcatttctgcacattaaatcataaatatttaaatatattaaaatggtggttttgcaaagtcttgttttataaggccctttgaaagaaaaacacctagctcacataaaggagtctttggtaatataaaacaaaaatgagtattccaaatatttcatagaaaacatatttaccttggccttatttaaattttatccaggaggaggaagtgagaagttatttaagagttgaattacacccaaatgaatcctatatattttatagtgcttccttgaaccctattcatatatacaaactatcaccttgtgtttcatggcttaggctgtggtcagtgaaattttcatgtatctgtgttgtgttaaggaaaagcctcccccatttcctttatcactccaaacggataagtagctaaatgtaaactgtgatttaggaggggagaacagggaatcaagagagctatacatcattttatttatctcttttaaattaagtataaactttaacagatatggatatgttatatatgtgtatatcatatataacatgatatatgtgtatatcatatataacatatgatatatatgatctcatcatatatgttatataacgtataatactcatttgctaaataaagaaaacatgtaacttaccttagtataaaaaacattttgcttcaccttaaagaaatttatcagactcaatgtgtagtggaaactcctgtattgaatgtccttaggaatttctgtttccaaatagtgctagttctcatggagttggttagaattatgagtctgcaattttgctctgctgaactcatcagaaatggctagtcagtttgtccttttttctctaaaaaatagaccatggcatttttgtttgaggggtattgctttctctgatctgtcttcacctgataaacgtgaaaataattttaaattaatgttttcttgactcaagtacaaagtcaacgtctgcatctccgtgtccctgaaactgtgcaatggaggtacaatatccttcaaatagattgttttattcctgtgtgtttgaataatgttcatgagtttaaaatattggcaaaataaaatattattaaaagcatgcaagatgtgtaggtcacacatacacttgtgaaattcaagtgcattatcactttctggttagaatgactataataaactagagaaacttgagttcagacaagtttccttattattccttatttccagacaatatgccttattgtttatgtctatataaatatgtgactaattaatgggttttccaaaaataattttctatttaaatgttcaaatcccataaaaatttatttaaaacacatgtacaagtatatatgcaaaaggacaggttaaaataattttcatgatatcattacccttctgtatgaatatgtagttcttttccttgcttgaaaaataataaagacctcaattttttttttttcaaggaagttgtggagttagcagtaggatgtttgtcaaaacacctgaagcagccccaatggatcttaattctcctgttcttaaggcactggggtcagcttgcatagagattaagtggatgccacctgaaaaaccaaatggaatcatcatcaactactttatttacaggtaagattggctgttactattatttttagttatttaagaatgcgtactgctccaacacagcagaatcaagagcattttatatttccataagagaatgaatgggaattcatgttgtgtttttttttgttttgttttgtatgtttgtttgtttgtttgtagcacctaccagtgaggactaagactggtgctcaaacttttacaaattaaccaaggaaaaaagccataactgccatataacatttttgattgagatctgtttgaaaactgagaccttatagcccacataggcttatatttagtgatggggcagaacagtcctctaaagcaggggttcctaacccccaggccacagagtccgcggcctgttaggaaccgggccacacagcaggtgagtggctggtgagcaagcattaccaccggagcttcacctcctgtcagattagtggtggcattagatactcacaggagtccaaaccctattgtgaactgcgcatgtgggggatctaggttgtgccttccttatcagaatctaatgcctgatgatctgaggtggaataatttcatcttgaaaccgtacaccctaactgcattgccccagtgtgtagaaaaattgtcttccacaaaaccagtccctggtgccaaaaagtttggggaccactgcttaagcagctcactgaccaagaaaacatagtctttccagagaggaaaccagatacaagacaagaattctaatatttctcattaattattatgtagagattaaaaagttttttctcctcctccaaagatggtgcttttcataagcagaaaaaggggctctcctctccagttttccttctgttttaatgagcctccactccactggttagatggtgttatagcaacttgttccatcatgtgcagaatttattaagtgtacctacctaaaataaagaaaagagacaatagggaagagaggaagagaaagattgaggaaaaagagagacaaagagagattgagagagagagagagaaaataatggaagagagagatacactatgaacattttggtttgaaggatattttgctctctgatctagtcttcaccagatcaacatgaacattgctttaaattaatgtattctttaaataaataatgaatgaggaggagaaggagcaggcaaaggaagagaatgagggagagatggagggagggagagaagaagagaaaaaatagagaaagtgaggggaggtgagtagaaagtacaatgcaaagagccaagggggcaaataacctgtcaactgatggcttgctacttaagacagaaaatacaatcattggtagacatacaggacttgcagattgaaaaacccaatcccattctgaaagcaatgtatttcctttagcgtacaaagcagaacacccttcttctcagatcctcataccccgcacctcttcaacatcctttgttagtgtctctagcagcctcaggccttcccttatttggtcctatgccctggaaacttagtgaaacttacttaggctcctcttataactttagatattgaaatcctttgattcacatcagtcttcagtgatgagctaagggcttatagaaaaaaattacgaaaggagaaagtattattgcatttctggttatgtaaatgacattaccaaaaatgaacaagccaaatttcttctcagcaaacattaatttgaagaataatatttctgattcaaaaacacatgaacacgtaaaaatggttaatgtgaatttccattttacgctaagcacattagtgcaggctctaaaatgtccaccctcttgaaatagttttctttcatccacttaatgctaattgcatgagaaaagcacatcaaattcctattcagaataaagggaaatagagtatctgttatagaccaggacgtggcttcactctgttggttttgtaaataaagctcgtgattacagtgcctattccatggcagctatagagagggaaaacaggaaatataatgcagaaagcccgcttcaatgaaaaatactgtaaattgaatttgacagcatttgatggcatctgattattctaatcacagccaaacaatgatataaagagtaatatgaaacagaatgtgttactgcctagcagactcaaaagcaataaaccttcctccaatgtgacacaatcacttcacaatcataattgtagcctgtttgatacctctgagtacagcagaagggcactgactgacatagatacattttgttttttatttaaagtgaaatgaaaatggcgcactggggctccagatacaatcgttatattcacctacataggcatgaatcacttggcagttatttcaactgaagtttaaatgtgcttagacaacaacaatatcaaatttttcttagatagctgcaaaaaataatcagaaatttgtaaggacagaaatagaatggagacacatagttctttttcattctgagactacatagagccctttatatagttatagccaccagcctgcagtatttctgaggaggttatggcatgtaatttcagcttcatcattggccttctctttcttctatcggcaccaaaggaagtacatttagctcaaaccaaagataggatttggcctatgcagatatttttattaacttgcaggaagcccacttgtaaatctcatttgaaattgtttgccactctcttctcaccaagaccctgaatcattttcttttctgtaactgtcctttattttttaaatatttcctctagatattatcctattaaaaaatatctgacctaataaagacagaagatgtttatgacttcaaaaacaaagcaaaataacctaaatattatcctattaaaaagcgtctgccctattaaagatagaagaatgtttataatttcaaaaacgaaacaaaataacctagtaagaacaaactattaatatgattccctctgcttagtttatctgtttaagctattttgttgactatatataagtcacaaaaaaagatttgctacaaaaagttttgtaaagaatagagaccaacatttaagttagtgttttgcaacctgtttattgactgagtatagacaagactgtcttggacatctgcttcctcctctcaatgagtttggctggtatgataatgattcttcagtattccccctttattttatatctgcaaccttgcaaatggcaaaaatctcatcacttacgtctacaaaatccatcaaacacattaaattgagactttacaaaacatgtaataaaataatctcctcccactaggtgctttaattttaatagaaaccaaatttcatggggtttattattctcatgagctttctctttaaataaataaaaagatttgatcaatgtgcactgagaggcaaaactatatacaaacaccctgtaaatgctgtaaaaatagaaacaaatgatggcacttccttctgagtatttagtaagatttaaaggataaaatctgaaataattttgaagactgtatgatatgaaagggttttcaaagcagataagtgaaaacattttataaaatggataattaagctgattgaattaactaagaaaagacgagcattgaatcaaaggcaaaggaattttgatgtaattcaatttgtattgggtggaaagatggatatagatatgaatatttatatagatagatacagacagaagacagacagacagacatctacctatccatacatgtacatatctactgagagagacacaaagatctatgagacctaagcccttttaccaatgatcttcactacagtgggagatataagacaggctaaataaacaaagaaaagagtaaaatatatagtggaaaaacagaaatatttaccagaaaatttagagaataattctgtgtctagaatattcatggaacacttcatcaagttgatgtcattgagactaggacttataaaataaagatttaatgactatttaaattgtaagagaaatacatttgttagaaaaaatgttttaacagtacagaagattactaaggttattattcattcttatgatttactcatggcatatgtaattttcactaatagaagtaacactattaattttaatatattaacattaatgttttctatttgtattttcttcttcatgaaagaattatattgcccatattgttctgcaattttctttgggcattttatatatatgcccacacacatatacacacctaatttcttttaatgactcatcaatattctgttatatggatgtgtatcatatattatttagccagtaccctgatgatggcaagataggtgattttcaagttttcgttaccacagcaattctctaataaatattcttacggtaagtatacagagaattattcttagtactagaagtactgggtcaattaaaattgttgaggatttgtctttactagaccatatgcatttaaaattgttgaggattcctaagttgtcttccaaatatcatatgtaagaatttctaattctgaaatcttttaatacagggtcagtcttccaaatctgtcagctcaatattttcatttgcacatttttgttgttttaattcaagttttgatgattataagtaagattgttcatttacttaaaatatttatcttctatttgggaggggtatgtataatatattataaattcttagactaattttttctactggattatttcttattgtctatattctttccacattaaagaaaatctccctttcatgatcatattaaaaataacacattaattatttcttccagcacttttatggctctactccttatttctaaatatggaattaatattgttattggaaattagataagaattcattttcttaaaaaatgctaactagtttatcaacattatttcataatccactgatttgaaatgtcactcatacaaaattcctatgtgcatcgggttcattttaggactttgtattctgtttcacttgtggtaaatagggattttaacaagtacagcctgatggtgaagacatgataagtgaataaaatcaatagaataagcaaaatttccaacacataagcataggattcaaggaatggtcaggtttatctggagtcattgctattagtaggggacatttagaagatcagcttaatgatagattttagatctaaggagtttaggctttatattcagaggcaatgtgagctgctgaaggtttagggggtaaatagagaagcaatgtaataaagtggaaagagtgtggcatttgtagtcagaagatatggcttccagggcctggctctaacacttactagttatatgaccttaggcaagtcactgtgttccctaattttccatttttacatgaagtgaagatagtaaatataaaagataattagcctcttggaattctgtaagaattaaataatatgtgtggaattactgttaaatgtgaagcatgataaaaatagaaagttatcctagatatgttgtccaaagccatgttttagaaagacaaatccatctggcagttatagatgtacatttaaagtcaatgaaagaggttcatggttataaaagtagcagcttgcataacagtatgcctggtaggattctgttttcctttaaatatatagtatattttttacatatatatgtatataaaaaaatgtctggaatgttaaacaccaaaatagtgctagcagtgcttatctccaaatattaggctatcagtgattcttttaaatacttctgcttttgttcatctgtgttttcttattaatttttatagtcaatacatcatatggtctagtaaagacaaaataataaatttgtgagcccagatgcaaatctatcatcactgtctccgattttcctatttccttctttgtgtgaatatcaccatcactttctgtaataatcaaagtctgatcaagaaagaggaaccacactacttactttaacagaaggaatttaatataaataattagtaagtagttataaatttgttaactaggtaactaaaagcataaaaagagaactctaagatatcatggaggtggcaactacaggaaacagctagcacctttagaactgagggaacaaaggggagttgttagaattattaaaatgtaaatgcatagaggagggtgcctgtgaagctgggactcagacagttgaagaggggtacctgccactggtgcagttgtatggaggaggaaacatgaaattaagttggttttccaaatgtcggaaaaattgcatgctgcaatcacttgctcccaaggtatttctttattgcaacacaagaacagcctaatacagaaaactggcaccaggagtagcgtgttgctatgaagatacctgaaaatgtggaagtgactttggaaatgggtaacgggcagaggttgaaagagttgggagggctcagaagaagacaggaaggtgagggaaaatttggaacttcttagagactggttaaatggttctcaccaaaatgctgatagaaatatggacagtgaagaccagactaatgaagttggagatgcaaataattgagaactagagtaaaggtcacccttgttatgccctagcaaagaactaggttccattacatccatgccccagggatttgtgaaagtgagaacttaagagtaaaaacctagggtactggtggaagaaatttcaaagcaacaaagcagcattcaagactttgcctggctgtttctaacagcctacaatcagatatgggagcaaaggaatgactcaaagttggaacttttatgtaaaagggaagcagagagcaaaagttcagaaaatttgcagcctggccctgtggtagagagagaattcaagcagactgtggagtgaccactttcaagagagactagcatcactgtaaggtagccaagtgttaatatccaagataatagggaaaaggcctagaaggcatttcagagatcttacaggcagcccctctcaacacaagcccagaggcctaggaggaaagaatggttttgagggccaggcccagagccctgctgccctgtgcaggcttgcgaactgttccccacatcctgactactcttgctgcagctgcagctcgaagggcctcagatacatcacaggtaggtgcttcagggggcgtacaccaaacccttggtagctaccatgtagtgttaagttggcagatgcacagaatgcaagcatgaaggaggcttggcagcttccccctagatttcagagaatgtatgagaaagcctgggtgcccaggcagaaggctgccacaggggtgaagcccttacagagaaactctactagggcagtgcagaaggcaagtgtggtgttggagccaccatacagagtctccatcagggcgctgtctgttggagctgtgggaagggggccacttctctctaggtcccagaaaccatggacagcttgtatcctgaaaaaagccatagggattcaactccaatatatgagagcagccacagggtctgcactctgcaaaaccacagggttgaagctacccaaagccttaggagtcagtgcttgcagcagtgtgccctggagtgggacatggagttaatggagactattttggagctttaaggtttaatgtctgtcctaccaggtctcagacttgtgtgggccctataggccctttctgttagccaatttctcccttttgcaatgagaatgtttacccaatacctatatccacattgtatcttggaagtaaataacttgttttgattttataggcttataggtgaaaggagatgagtctccagatgagattttagacttggtacttgagacttggggcttttgagttaatgctgtaatcagttaaaacttcggggaactattgggaggacatgatttcattttgaaatgtgagaaagagatgagatttgggaggccagtggtggaataatatagtttgtatgtttgtcctctctaaatctcatgctaaaaacagattcccaatgttgcagatggggcctagtgggaggtgattgcataatggggtcagatcccttatgaatggtgtagcaccatgcccttagtgataagtgtgttcttgctcagtttgttcatgatgggagatctggttgtttaaatgtctaggactccacccgccccccgcccccccgccacctctctctcttgctcctgctctctgcacgtgatgcacttgctctttcttcaccttccatcatagttgtaagcttcctgagtctctcataagcagatgccagcatcatgctttctgtacgccctgcaggactgtgagccagttaaatccctattctgtataaattagcttacctcaagtatttttgtagcaatgcaaaaggagcctaatacaaattagaaaaaagaggtagcacatagaaggatatgataactcttatttgagagaaaagcaaggaaaagactttctggaaaaagtgatatggggctagaattttaaaagacgagttgtagttagtctatagaaaaaaggagaggccaggtgtggtggctcacacctgtaatcccagcactttgggaggctgaagagggcagatcacaaggtcaggagatcgagaccatcctggctaacacagtgaaaccccgtctctattaaaaatacaaaaaattagccaggcatggtggcaggcacctgtagtcccagccactcgggaggctgaggcaggagaatggcgtgaacctgggaggcggagcttgcagtgagccgagattgccccactgcactccagcctgggcaacagagcaaaaaaaaaaaaaaaaaaaaaaaaaaaagaaagaaaaaaggagaataagaaagaggattgggagggatattgccagagaattagcagataccaaagccatggaaccgtgaaatataatggaatataagaaactatagtcaagcatttgatgataactagaatataaaatgggactagaaatttcagaaaggtgagtccttttgagaatcagcagattaaggataagcataggccattttacatggtaaatctctaaagaatttttaaaaggactgtcttaaaatttttgaaaggtttgtgatgtctcttccctcaacagccaagtctctactcacaccaaaaacttgacgattcaaccttcacaaatcattttgtaaatcacctgtgtttccatttgtcctctcagcaatctagttcagggtctgcatttattcttacgtaaactgttgagatgacctccttgttcaatgccagatgcacatcatctccatgataacttcattcagatcatgcattacattttacccaatgatttttatgttttaatttttataagaattttcagaggtttgttatactctatgaggttattaactccactttacaaaatgaaatagaaactagaggacacagacaggcaagttcacccaaggtcattgaactaagtggcagagccaggacctccaacctatctcctctgactacagatgtttctgattatctatttaaactcagaatatttgtaatattcttcatggaatggggttggcagtttcataacctcaaaattgttatggtgcattgggttctaggattttgttttaattgcttttgaaaataagcagtgacaattgctggaggggagagaaggagtaaggagctcctaaaagcattgtacattgagaccacagaagtgtgactgcctttaaaaatatatggttcctagtttttatacttatttttgttttcctcttagtgttaggcaacattaaattaactctagttggaaaattacattcctgaagtatctcccaaatgagcctgagcaaagaataaccatttggctattcagagagaactgaaaatgtgatttctctaaacacaggctactcaggaggaaacacttccagttaaatgaacaggtgatgcttaaatcttaaataattaggaataattgtggtctactcaaccacttctgctctaaatgtattcagacataaagagagactctgttttttagcagtgcagatgggacatgtacttctccacgatattaatttttcaaggattcaatagcgataagaaatacttaaccaggctgcaccttttaattcttttggtgaataaacttgaggccaacataatactcaatcttttaaatagtatatgtatttaaaaccccacttttaggcaaattttgttaagaatgtcggctttatagaaaccatgactacatctcaatttgggaattcgtgagagtttaataaaaattaattgaattgtcatggaaaggctgaagctagacaaaatagaaaatgttacttccccatagaccatcataggtttgtttgctgtattgtgttcctagcaaacaactttttaaaaatcactgagaagagtccttggctatgagccctgcagttctcattagaatggatctctcccaatgacacacctggtacctgatatctgtagcaagtacaaaggccaaaccctgcaaaccttcactgagtgcagaatctggttcacgcatggtagtgagcaataatgaggtgggctgccgaaccataattgcaggtgactgagaggtgtctatgaagcctctatagcttccagcatgaagcttgtcattgctcatacttaggtcatcgtgatttatcaacttaaggatcatcagattcccaaagccaaagattttacatattctgcctttttgtgaaaggtaactgtcattcactttgtcttaataaccctttacattttgatggagctggttaatctgatatggcagcatgtgaatttttcagcatctgaagagtgtgttaattaaatacttctaacagcctggaaaatattactgtattcatcactctcttctcaactagagagagagctgaaagaggagggtcaatgtcttggttacattctctcccaacctggaatactgccctgataggaaataagagctgatggagaagaggcaaagatgcagggaagtaatgggattccataacttttagcctttcacttgaaaaacatgattgaacacttactgggctcagatgctgggaatatagagatatgccaaccacagttcctccagaactttgctttccatcaaacctgcatcatgtttttacatctggatgagaaaagaactgttccaaatgaagtatcagatatatagggccgtctcaacaactcaccattccatttctcttacttctatatttaatgctatatatatttagtaccaaaagagtatgcatttggccctagtttccctatcaacaaaatctaaagatgagcctaaacaattccatcctcagacagttgaaagaattttggggtcatactctgcattttaccaggttttggggaagacatctaaaaggaatttgacttttgtcctttaaaaatctctaaagcaagccagacatggtggctcatgcctgtaatcccagcactttggaaggccaaggccagaggcttgcttggggaagaccagcctgggcaacatggcaagacctcatctctacaaaaaaattttaaaagttagccaggcctagtagcacacatctgtagtcctagctactcaggagactgaggcaggaggatttcttgagtccaggagtttgaggctgcagttagccatgattgcatcaatgcactccagcctgagtgacagagtgagacccagtctcaaaataaataaataaaacaaaaaaactctaaaacaaattcctattatattacttatcatgttattttcattaatctgcacatagctccatcttctctactcagctacctattcctttaggtaaggggtgtgttcatctttttacccttgtttctaatacaatgatgggcatataacagtgcttaataaagttgttgatgtataagtacaataaatgtagaaaaaacagtggtcttgatgtataagaaaagattgtccatactttgagaggttatggtttaaattatagaagagaaaattcaaatgaagagaaattaagtggcatctaagaagtgaatttaaaatactttgtaaacatcctgggaacaattgcaaaagagcattgtgctgcatgagagaaaataggaactgtggacttcccttcatagttcttcatcatccagtatgccaacctgggctttttcacacagtaattttatggtcctaagagcagcaaaaggatcatcctcaatgtgcaaacacttttgaagtctctgcaatcatcatatttgctactgtcccatgagccaaaaaagtcatatagccaagctcagagtgagtttacgagcatactcgcaaaaggcctggatacaggaagacaaacacattgggaccctagctgcaatccatttatcatagaagggtaaggattcccaataatagcttctactaattccatatcctgtggttccagttgtacaaaaaataaaaccccgatataactgcatgcatacatgcacacacacacagacacatacacacagatctggaaaatatataaaaatgcattaataatgtttaatatatgcttctgtatttttaaaagattttaaatatgtttgttttcttgtattgcatatgtatcttgttattcagcaaaaacatctggaagataataaaatgtgattttggatgaggtttcaccttttgtgctttttatatttcttctgtgttttccatgttttctacaaagcatatgcactcttttataatcagtcaaatacgtgtgtgtgtgtgtgtgtgtgtgtcaactacactttaaaaatgatatggagttaggccactggagtacttctccatctggtttttctttactatgacaccaggaagaaacagctgaaaagttaagttgataacaaattctaaaaaaaatgtttttactccatctacaaactttgttttgaagtgtgcagctgtcactggttgcctgcttggtttcctttcagacgccctgctggcattgaagaggagtctgttttatttgtctggtcagaaggagcccttgaatttatggatgaaggagacaccctgaggcctttcacactctacgaatatcgggtcagagcctgtaactccaagggttcagtggagagtctgtggtcattaacacaaactctggaagctccacctcaagattttccagctccttgggctcaagccacgagtgctcattcagttctgttgaattggacaaagccagaatctcccaatggcattatctcccattaccgtgtggtctaccaggagagacccgacgatcctacatttaacagccctaccgtgcatgctttcacagtgaaggtaagaccctttagaaaagtaacagacatgcagattatctggtgaatacgttgaaattaattttcttgtccaacttctcatttttcttcacttagggcttaaatatatgaaaatctttcacttgtgaaaagttgcaatgtagtcacggggataagatactgaactgagtatgaggagtattggagaccagtttgtagaccacgactaattttgattacctcaaaaccaataaataaattttatttattcataaaattgcctgatttccattttccatatttactaagtgggaatattttttttttgagacaggctctcattctgtcacccaaactggagtggagtggcgtggtctcagctcaccacagcttctgcctcctaggtttaagcaattctcctgcctcagcctcctgagtagctgggattacaggtgcccaccactgcccaactaatttttgtatttttaatagagaggggttttcaccatgttggccaggctagtctcgaactcctgacctcaagtgatctgcctgcctcagcctcccaaagttctgggattacaggcgtaagccactgcgcctggcctaaatggaaataatttagtcttgatttccattttccatgtctactaaatgggaataatgtaatgctttcctccatacctcatagagatgaggttcagatgaaattagacagaatatttaattttctacttccccaacaagctagtataatatatagctatatatatatgtatatgtatatatgtatgtgtatacatgtttgtgtatatatgtatttgtatatatgtgtgtatgtatgtgtgtgtatatatgtatttatgtatatatttaaatatacacacacacacatacacaaagttgcatacactatggcttactggtgatttttttcagggatggcttcctctggcccatagaacgacttaattcagttcacctgagcacttagtagctcctgagtgctttctttatgtccagcataacctcatggtctatggaatatacagaaacaggatggtccttgtcacagggagtgttccgttttataatattgcagagatgagaattgcacataaggggaaaagaatgagaagcagttgagtacagcctataatgtccactacactgagacttagatcccgaactccactatctactagctttaaaccacagtacaagagagagtaacatcatataccaagtgttaggcaagaaatgctctgggagatcaactctcaaactgaagatgcttcatggataagattaaattttgtggtcttgggagtgaaatacaaatatgtgccaagaccttattaaatatggaaaaccctcaataagaacaaataaacagacaaactaaagcatttataaaaaaaccaaaaaactatgtttctatgctttaaatcctggaaggccaatttacatgaaggttatcttatggaggataacatttatcaaaatatttaaattacagtgagcaaatatattttcattaaactccagaagagcccttttaaattaatagtttaaagtacaatgttttcccactgtcctcatgtttaattttctcatatgactaaaaaataagcaatatgtaaatgaaaggataattgttttatcttcatttttatctgtttcagaattagtactatatttttattagatagtaaattatgtactagagtcttttatattatgtcttctagttcctatatgataagcattagaagcagtgttcttaagtgtaaaagatactttttagtggatatgtgatccaggaggaagttcgttacttcccaccatatccttcaaactcatgttctaaactttcacccttaaagtaaaacgtttatgagtatactgaaacacccttgttaatagctttctgaatgaggcaccttaatttaaatatgtttttattgaaggcatcaggattataatgattaaacctctgatcttttaaaatacaactttcaggggtaggagcctaataatcatttagtctcacgaaacagttctattggaattcccttgtggaataaccctgtaagtcatcccttcataaccagcttcattttaaaacacaagatttaaagtatatgatgaatccatgaactctgttctttatttaatcttctaggctctatttttatcacactaaaaagcttctgaaaagaggcaagtgtatggccccaagctttaagcggcacagggctctttgcacatgggccctccctgatgtggctttcattttgacagtccagtactggtgtgcttttctatttttccaaagattttttttcttgcaatgtcgaatagattagccagaataattttaaaaacaatacttctgtgtcctatttttgaatgtgtatgtgtgtattcaaagtggcctcccaaaacctaaatctttggctcttagaatttcaagagaaggcttcattagatacaccaagaaaggtcccacctgatcttttcaagcaaacaaggacatcttccacaaagcaatctaggcaagtgttcagaccttctggccactggaccacgttttcagggcatcagggcaactatgactctttatgatctgacacctttgaaggaagtcatcaggaaaatgaactagtgtttttgtgtttcacttattcccacagtccctgtgtaggagattgtgttcaatatttttgtttaaaagatatctaggccagacgcagtggctcatgcctgtgatcccagcactttgggaagctgaggcgggcagatcacaaggtcaggagttccagaccagcctggccaacatggtgaaaccttgtctgtactaaaaacactatttttagtatttttactatttgagaggctgaggcaggagaattgcttgaacccaggaggccacggttgcagtgagccaagatcatgccaccacactccaacctgggcaacagagcaagactccgtctcaaaaaaaagtaaaggaagttctattacttatccagggttctatactcctcaccgtcacagaagaatgtttcttttatctcagacaaatcctgcctcctataatttaagtctatctccctttgttcagagcagcatgacttctccataatagcacaaaggggcttcagggtccaacaaattattgacaattcaatctgatttggcaaataaccattgagtactatattcaatatgtcaatattgaataccaaacttaactatgttgttgaagtctactgtgagacttggcccttgagcagagcagagactgtgaggaagaatgagtgattcgttctgaggcacaggctattactgttgggcattttgggtttttaagcttcttgcagctgcgtttctgctgcccatgtttagaagaccccatttcatttttatttttgtataaacttaatgggtccaagtgaagttttgttacctggatatattgtgaagcagtgaaatctgggcttttagtgtaaccgtcgcacaaataatgtacatcgtacccatcaggtcatttctcatccctcaccctgctccctccctccctcccacccttccgagtctccagtgtctattattccacaccctatgtccacatgtatatattatgtagtcctacttataagtgagaacgtgcggtatttgactgtctgtgtctgagttacttcatgaggataatggcctctagttccatccatgttgctgcaaaagacatgatttcattcttttttatggctgagtagtattctacagtgtgtgtgtttgtgtgtgtgtgtgtgtgtgtgtgtgtgtttcacattctatatatatccatatatataattacattctatggtgtgtaaaattattcctatttagtaaatatggaaagtggaaatggaaatcaggagatatatagatatagatatagatgatatagatatagatatagatatagatatcacattctgtttatgcaatcatccattgatgaacacttaggttgattcaatatctttgctattgtgaatagtgccgtaatacacatacgaatgcaggtatcttttttaatataatgatttattttcctttgggtagatgcccagtagtgagactgctggattgaacggtaattctacttttagttctttgagaaatctctatattgttgtatattgagaaatctctataggggttgtagaagactccattttaaatcgcatcccaagtacttccctagatctacttactgtttatctaatttctgcaccaggtaaacaactttactgtcttctttcctttctgtgcctgctgtaggaaatttttcaagtttttgtttattggccactctggctaaaattcttcagggcaaaggaactacagaaccttctccattaatgaggcacagagtccatccccacaactgtaggattgcagttcagtccacaaactcgcaagaggtactgctaatgcattagtcccttgtttattaagatctcatctctgcccaaggggccatcaataaattgcccatgttgtggtgccatcactagcttgccccaaggtccccccagagttgtttatagacaggtggatgttgctgagagagccacataaaacaggtgcaatggaggcatgaattctgcttgtggtggcagtggatggagaactggcagtgggggccctccgtgggggtgagaagcgtatgtgttggcaggaacagcagcagcggcagcagcagcagaggcagcaggagcagagaaatggaaagagtgtgggttttaatgcatcactagctgctctcccaacctcatgaaaagtttcacctccctactcatctctatgtaggtctttctaaggaagaaagagggagatcaagattcttggggtctctttagaccaataccttccattattgaaaacagctttaattagaaggccttaaactcccttcccaattagctctgtgatgaattgtgcggtgtcaggaaagaaactgtatttagccttgcttggcatgcaggagttccatggtggtatttacagggaacactcctggcaaggttggcgatattgctaccaccatttgggtttgtttgctttttctcactggcatctgccattgtgctggcagaaataaatctgataatttgggattttaaagaaaaaggtggtttacctattatctgtgccctaactatatccttgcttgttccacggggttataaaacgtcaagcccagatcatgcatttgcccagtatcctaaaagataaatggtacttcactctgtgtagaatcaagcataaggtgctgagaaataagcaaattatatgggtcactaaaaattggcttccaatctgggaataaaatccagaattactaactctagtttctagattctagttgccaggcttcctttcccaatgtcaaggaggaggtagtcaaaatttcctcaagggtttgtttcctatatctttaccattaagtagatatgtggcaaaaataataacaataataataaaatagatatttcacaattgccatgttatgaagagtgtgtgagtaaattgataaatttatttttaatcccattttcattttggcttagataacataaaatattactgctctttacatatgatcttaaattagtttcaactctttttaatttgatgattcttagccttttctccccagacacatttattagacaacagaaatactctgggagatgtagctttctaaaaggactcctttggtgactatctttctaatgtgaagaaaaattcagtaataaaaataattatcatatttcctgggtcggttctataaactgagattttcacattttataataagaaataactgtgtcattcttctatataaaagatagaaaacatgggtgagtaaatatcacacaaaacaatgaatatttgtcggcctaaccctttttttttttttttttaaagagacagggtcttgctctgtcacacaggctgcagtgcagtggcaccatcatagctcactgcagccttgatgtcctgcactgaagtgatcctccctcctcagcctcccaagtagctgggactataggtgcatgccaccatgcccagctaattttttaaattttttgtagagattgtgtctcactaaattgccccagctggtctcaaattcccggcctcaagagatcctcccgctgcggcgtcccaaagtgttggaattacaggcttgagccactgaccatggcaaaactttttagttgtgatgatattttagctttaatatcaacttttcatttacttgccttacataatctttaacccttttgtctaatttgggctagacaaattagactttcagacaaatatgtatttgtctgaaagtcataaatacatataaagaatctaccttttgctcaacattattggggatgaaaaccatgtaagtcttttgaaatttatgtaattacatctttgaaagagccatatttttctccaaccactttatcccagcaagctccatcaggattcccttgctcacccatcagtaacatctaaggcaggtcccatgattttccagtcacttttcagtggcaaggatcaacgcaactggtgattaagactcattccaagtgttttttaaaaacttcagtctagactgggggcgatggctcatgcctgtaatctcagcactttgggaggccgaggtgggtggattacctgaggtcaggcgttcgagaccagcctggccaacgtggtgaaatcctgtctctagtaaaaatacaaaaattagccaagcatggtggctggtgcctgtaattccagccactctggaggctgaggcaggggaatttcttggacccgggaggtggaggctgcagagagccgagattgcaccattgcattccagcctgggtgacagggcaagaacctgtctcaaaaaacaacaacaacaacaacaaaaactccagtctaaattaaaacctgatatgtgcttaaggatctgcagtggggaaagagggcatggtcattttcctctttcttcagttccctcttctcttatttatttccccaggatcatggcatgaaaagaaagaattagacaaaaaggaacagagctttactcaataatattgctctaattaatcttctattaattttgagggggcagatgcctcatgggattttctctgtgggttatataggggtccccataggaaattccatgcctcatagtcctctgatgcaggcaatacactctctggctaatttcttactatttgttattgtccaagaggtccaccctacaacctttttttgcctctgggggcccttctcccaagcaggcagccaatatcaagtcctatcacgttgacaaaactcattcctttcttggcacccactaggattgcagaaaactttggtttcaccaaataatgaaggtacagcttgtccagtactatattctctgcttgacctatcatgctggatgaaacctagccagtctcctaactttggaattcattgactaagacacaggtattagcttctgtgctagcctattatcccaaaactatgggatcacttaaggatttcagaagacccttttgactctagtcattgcatcaaaattgtcctatgaatttcatcagtgcagtaggaagcctcttgccaagaccagactgttcatctcacttttctggcaacactcccaatttcttcaagagcttctcttggatattccttgcatgccttgaaaggggagtgtggagaaatcccattccctccctgaagtgggaaagatataaccaaagcctctttcttctccactgaatccccttctttaattttttttatgaacttggatcttctcatataggttgtctacatagatcttcataggaagatggatcttgaagtctgttttttccataagtcatgcagtgatatgtctagctgttccagtagagttacttaccacctatttttctaaatcatactcattattctccaatacagttctgtttcacatcctattatataactaaatggccctatcatctttctagttgcacaagccagatcatttttgagtcctctctcttccttacttccatatcaattcttcactaagtgctattgattctatttccaaaccatatcttaaatccttccacttgaagacaacattaggatcttcacacatgttaatccctcctcctggaatgatggctcattctcctataattcatctgtcctcattcttactcatcaagtctgaactaaaatgttgcttatctcatagggctgctgcaatgactaataaattaatgtatatgcaaagtactgtaaagggcaatataaatagactataaacctttagcagtccttctttttgaaaaaacagagactggaataaattagcaaatgtagataaggttctggtttgtctaggcaactgtactaatttggtcatgagtgaaaaaccttatgttttatacattttaagtgttcctcaccttgcaataaaattctgagcttgcaaatttacatgtttcctgataccacattgttaatttccctgtaattttccaaatactggattaggttctatttcctttctaaactgcctgaagcaagaacatgctttttttttttttttttttttgtctcctgaggtttattacggtcttatccctggcccccctgccccaacaacatcacatacctgccagtctaagagccctcctcaggagatttccaccctatatgtagttctctttacctgacatgacactcttaggaccctaccctttcccttagatctgggattatatcagcagaacatgatgaggtattttagtcacacacacacacagacacacactctcacacttctcaaatcatacaaatggattctgccaaattggcatctacctacttcccctatgccaaatagtagtttatcagtacatgagggacagttagttggtggggagactgtttgacctgtgagtcaagtatgttgctattttctggcctttaaccaacttacaaggaaaccctctttagacacctaagactcccgtggagccttgtcaaaaatgtctgtgaaagtaaaatgaactagtccacatactaacaggcccaggccataaattcagaatatatgccatttagcagagacagcaagctgtaaatggcagtgaagggcagaagttaattgaactactctgctcttgtcacagatggaaagtagccactacctgagacaagatggctgccccgaagtaccctattacagccaagagatcatatccttagctctgcaagggcttatgggtgagggggaaatcatacacagatgaccaatttttttatggttcacagccgataaaagtgaaattcagcagctgttcaggacaagtgaccactgtaacagctgtaatataacctactaaatagagagggaattgcattagagcaagaggttagctgtgatcatcggcaggtgagtgctttattgaagttgaaagaccattaacattgatagagtaattatttcaacttgaaagtaattaccttgatgggtgataacttctctagtgttcccagatttgattgggccaaacaattgtgagctcctgaagcctagaaaaatattacaacaatactgtgatttttaaattactgaaaccactgttggaatattctaattatgccgaacagtgaaaagattttgccttacacaagctagtgacctctcatgtagagagagacatttgctttttaatccaaatgcaatgacccacacccaccacctgtgaatacatatgtgatgggtttgcaaatgaatctttttatctcaatataatttttaaggtgaaacatcttgttagtgctgtgcctgggtaatagtaagctagaactgctgacatttttgatcatatctatggacttgaagtctccagaatggcaactatcttctatctttgtcacagagggtttaaatttgtataaattaaatattttgataatgactacacataaattagaatttctggatgccacgtactttggatcccaaatttcagatattatctagttacataatcagttgtttaaataactttctcgcctgatgttatgcaactccactacaaacactccattgtcagggtattttccgtttacctacactggacatcagcaaacaaaattaaagttgaaaacctgggctattgcttctctgtagtctcatgaatatatgaaaattgcaagttatttgcaattgagggccaagacacatcaaatctaattcagtgatcaagaccaagaaatacagggctcttccattaatcagtttttcaccatatttctcttttgagaatctacttggtccagaagctataacagatacaaacaaacgagaaatagtcttttctctctgaaactcgtcgtgtatttggagaaacaataagaaaagagacaaaatacaatgtaataagcaatcattttgtcatgcatggtattgattgtacttataaatagttacaagaacctaggaagactctagcccatactcctgaatccaaacccagcactcattctatggaaccacaaaccattgacagaaaaaacacaggcatcatgattcttagtcatgttgtcagaaaagatgaatgtgacatcaccttaaagttcctggatgattccgtagacctttctatcatcttggcagggtttgatcagatgatcagccaatgaatgactatctttttggcggcacttcccaggagttttttctaatcaaaatctcagactctcctagggacaaaacaggtttctacttgttgtctaagagccaataaggaatgttttaccaagcagttaatgggtttctttcatctctccatctcggctctgaattcccctccatagacaaagtctttgggtctctgtttcagaaattaccgtagggtagaaatctctgccaagccagaagacatttgcccactggaaagtaatgtaactggcttgaatttggtaaaagagtgaaggtttgagacaaaaacataccacttgggaaagtgataaaaatttatgaattgaattgtaaatcttgccattaagccaaccaaagagtaacaaaatctgaccaatctgacagcacatcagagttcttagcacagcaggctcaccatgtgtcatatacagccaggctaaagattgtattaaggacccccttaggtactctgaatttaaaataagtgtaataactcatttttaaacattttatatgatacttgaattattaaatattcacattacaaaatcagagaattttaatccattcaaaagggtgggttgtctaacactgaaagataatggtcatgtctagatagtaaaattacagtatatttttaacggatgtacatgttactttttgacaagacacaagtagtgaattttatcgtacaaattcctattgggtgattatgatacagagttttatttttgctaaagcaattactaatgtcatggctggatacctgtgcccattagtggctggttctgtgtttttttaggatggttattgatctcttgctgagctgagattcaggttttatgccagatagcttgattaatgggttggtttctataagtggactgaatggggatagaaagcaggggcagcctgctctgccaaccccaaatccgtcaagacgcatagctcattatgaaacagttatcaaggatacatgaaaaattaattgggctcagtttgattctgaaaagaatcggctttctacttggcgggcccccccgccccccttccactctttccagatgttctgcaccagcccctagagaaacagcaaagggagacgtattaatacattgtattgattagatcaagacccctgacagttatttgtagagataccatctggctgctgttcgaattccttcaccaaaaacaggacgtgacatgttattaatctcaactctctaagtatagacagttgccttttctgctaaaccgcattttaccattccgtaggagatggaggaagacctgaagggtgcagaaattaaggttattacacaaattgagccatatggtccaaatatttcagcaagaaaattgccaggcaataaaaattgctcctgccttcctaatggtgtaaattacagtttaaccatggctctaatgatgtccttctgccgcgcttaactactgttacatgaaggacattgttttaaaaatataaaaaacaagtaaatgccagcagcgtgttttacaatctgttagtgtgtcattaagaacactgtcagaattacataaacataatggcaggcaacccagcatacaaaggaactcgtatggaaatagaaagtgtcttgaaaactctcttcattatctctgaaatgtcaagagcactgtcccctctggaagttttctagggagaaaagacctgtccatctagtgctttattctaattctcatgtgtgtcccaacagcagtgttttctaaatcaagtgtcacaacccatagtgagactaagtacacatctggtaccacaaccctgtccatatacaaaaaatgaagcagacaaggtgaggagacagctaatgaattctaaacaaaatgatagacgttgaccttttgaagtatttttgtttttggggaaaacagttaagactccactatcttccttgatgatgacatcaacaattaaaagtataatttctatcctcagcaaactaacctggcaacagaaaaccaaataccacatgttctcacttgtaagtgggagctgaacaatgagaacacatggacacagggaggggaacaacccacactggggcctattaggggggtgaggggaggaagagcatcaggataagtagctaatgcatgtggggcttaatacctaggtgatgggttaataggtgcagcaaaccaccatggcacacgtttacctatgtaacaaacctgcacatcctgcacgtgtatcccggaactttaaattaaattttaaaagtataatttctgtcatccctatttggggcatgatattaagaggaagcttacttaagataatcaaaaatctttgggaattacaataaagaccattaatatttgagtaagacttgaacccttcaaatatttttagacctattacaccaaaaacacctcggcacttaaaaattccatataggtcatattgatgttttattctctaaaactgcacaatcctccaagctttttggtcttctaagatgttataaacacagtttgttaaaggaaaagtccagataaacgtttgtagaaaaatttgaagggaaaactacttttaattcccagaggagagttgccttatctttaagccctttttccttctccatttccccaaagggagaaagaccaggatataaattgccctttaaactaaaaaagaaaaaagagagggaaaaaacctaggaaaccaaaaaattattctttttgcatgcatgcattaatattaatgagaacccattaagttattatttcctcatggcacaaatggcaaggctagcaatctattgactagagcatcttctgcctggaaagctcttacccaggtgtccccatggttggctcccacactttcttctggtcttaagtgaaaagttactaccactaaagccttacctggcctactcagctacaatttcactccactctccctcacacacactttctattcctcttctgtctttatttttctctttaatatttagcttttatttctggtttcttgctaacctgtaatcatatttcagaaattgtttttcaaatgctttgttatgcttcttatttcacctaaaaggaaatctgtatgttcacagctaaatcaaactgagaaagcatcatttatatgttccaatttcaatttataagctgacaacttccacataaaacatattatgggcactttacacatgccatcttatttcacctcaataaccaatctgtggagtattattacctaaatttattaatgaggaaatggaaactcagagaggttaagtagcatacccaaggtcacacagctagctgcagagtttggatttgattgcagctctctcagcttctaaagccttttctttctgttatccagtattgcttcttgagtttcagcctagtggaacaagatgttatttatgaaaagctaaacatcaatgaaagccacaaattatagttcaataggacaaagagatgacacagagcttgatatgattcattgcctagtataaatatagaaaacaattgataaaagtttcaaagaattaaaagatcacttggactggaaaagttcagagaaggcttttgggagaggtctgtgctttgaacaatgggtgaaattcaaatagaagaaaagtagaacagatattaccttattcaggcaaagaaacagaagcctggttttgaaacatctgatggcaagtctctgcttcaggaggtcacatggggaatatttttccaatatgcccccattaattgggctgatattaaaacaactgatttaaaaaaaaaatcaaaatactcccaagagatgcctagcaaagctattgagtgaggtggttagcagcatgggtctggggtcaggaaacatagattagagactggctttggcttttttactcattgtatgccttcaggaggttatgcctaatagtgcctcccgcagagaggcagcacctcttagagtcgcaggaactgagacggcactcagtaaatagtggtgagtaagattcaaaataggttttcagagaagaaatcagcacatgaagatatcatggtgtcatagtgtgttgacagggtcctgtctggagatactagtccagaatttcaaaaaaaggaaaagttttcttctggccgggcgctgtggctcatgcctgtaatcccagcactttgggaagccgaggtgggcagatcacctgaggtcgggagtttgagatcagcctggccaacatggcaaaaccccatctctactaaaaatacacaaattagccgggcatggtggtgggcacctgtaatcccagcaacttgggaggctgaggcagggagaattgcttgaacccaggaggtggaggttgcagtgagccgagatctgccactgcactccagcctgggtgacagagcaagactccaaaaaaaaataaaagaaagaacaaaagaaaagaaagacaggaaggaaggaaggaaaatttattatattttcttgtttcccctgcattccctaatacccctttcccaaaagtatggatttcttcactaaatatgttagtagcagaatggtcttgtggcagttgacccaagactccaggtagagcagtggggaaagaaaagacaaggccagccaagaggccagccaagaggacaagctcctccaaaggttgacttgagatattaaactcattgaaaaagttactcaacatccacagtgttctggtggtacctcacttagtcctggacaatgaatcacagcccaagcttcatcattgaattggtgacactgccgagggccaactcaccagccttcaaaaacgacagtgctgctgacagcaaaggcgatgaggacacacatgtgcatccacccttgagatgctaaaagaggcaggaaagaacttgagggaaagaacaaatcactcttctgagattgtcctataaactttataccaggacctatgctatcatcctccttacctaatcatgtttaatatctgatttataagaatctaaatgtgtacctaaaagtagctttctaaatattactgggccacattaaactgtgaccaattttcttccttcctggcctaccacattttagaaatatgatagcatatttgggttgggagtcgctaaaggcctcaagagagtccatctctttgtcctttctgactaggaagacctggtcatcacgccacaagccttggtgtctcgtttttaacagagcaataattatttattagtggaatatatgcttattatatccagaaattaaagttgttaggggacatttgtgtatccaggtccctgtggctgggtgatcgcatctgttagaaataaatcactttaagaaaattatattagccccacagacagtcaagaatggagcaaagggagggaagtgtgaatagggtgaggaagcttgattttaaatcttgtgaaatagagtgtggtcaatatgttgtcagcacattacagtgtgcagacatcaactccatttttcccctctttgaacctcaggtggccaattaacagtatatgctatttattcattacaaaacaggcaggacaaattgaatggttagaatgactaataagaattcttagcaaggagtaaaataaaaaatgatacataaggagagaccccccagaaaaactttagggatttccagaaaaaaaagtcttgaggagttttcctgttaaatgtatctagaatttctactgacatgaggaaattaaaatggaaagattctctttgaatacattttcttcctaaaatatgttctcttcaattccctcatttgtatttccttagagtttcattccttcctaaagcagaaagacagttttaaattacttctagcaattataagtatcattagggtgttttgatgctgcatttttacaacaagcactgtgcttgccttccttatttgtctctcagttcaactccaagtcgcaacacaggaaatgaaaaccttgtaaattgacttgatcttatgaatactcacttttgcaaatatgaaagaacttaagaagggattataaaatactccttatctatataattaaaattcagttgaaatatatgaattcaatattttaattcatgcatttcattttgcgggcattcaaagattatatgcttctatatgtctgccattgatttctgtaaataacattatctctcttattgcaaaacgtacatcagaagaagttggaagaaagcgagggcttgagggatgttaaactgaagcagcagtgacttactatgcagtgttagtagattgcttgccttgaggatctagaagccgatagaagaaatggagccagcaaataagaaatttcttatttcttattccagaaataagaaattctgaacttttaccttcaaagatccaaaaagaacatgctaatgttcttttttttctaacttttgagtaatttagtcattctcgttcagaaaattaagggtctacatctggcagcaactgaaataaatggctcaattgagtacacacttgaatgtcaaatatatcactttaaaagtcaatatttgtttcagctgtaaatgtttctgaacggaaatgatgcttttagtgtctgtagtctaaggagtagttttatttttgaaccctcaaattgagtgctccacctagagccgtaggaccctttcctttccatgaggagagcgccctctactgggtatgtttacttaccacgcatgactgttaagaccctgagctaaacgtatgagcagttgagatgtacataagaaagagtttttggaaaatctttgcccctgcttgtactagaatgattgcaagtgtggaagtagccatagttcactgtagttttctttttactgctgtattattgcaccctgttgggggatacatctgagcatttcatgtgtcctacttttaaaatgcccagatggtggctacgtgctttggtttgaattgggcagccctcatctttcatgctctgtagtctgcctcgttatcagagagacatgagacaaggaaaattcttccatttttcagctcctcttcatctgtttctagtcacccacagtgaatgatgcacttgcacaattgttaaaatgacagtcactgtgataactgaacatcacttccctgggatggggagttccctatgtacccatagcttcttgattccttcccaatacagcacctttttcagtgtaactgatcacttgcaatcttgtaagtaacacagcagtgagaggcagtgtaaatattttataccttgccccaatcacttgtatgtgcatcggtcttcttcactctagcctttaagcttaacagagattttaaatcaaatcattcaaccctagaaatagtcaaaagaattaataaaataaatgaaacagtgtaactggttaaaatagccccagtgcacaatacaggtttagtatgattttgtgacatacacattttatagggcttttgtctccaactacattcttcaaagagccatctgggcaatgaccataggtatcatttttaccaataatagtcagcacttcccactgggaaattagtcaagggaatgagtttttttttttttttttttttttttacaaattatcttcaagcatctatcttccaaaaagtattactggactttgtccattacaaggcaacaacctaagtgagttacttgtgctcttattttagaactttattcatcagatcattgtgatcaaactcaatttcattttcaaagaggaaaaagattttgctctgtttttcttcttaataataggtttgctgaaggaagaacattaatacaggtcagcgatctccaaactttttagaatattcacttgtagaaataataatttggggagcacacatctgcataatatgtatatttacttatttgtaaattataaaatatgtactagttaaatagtatcatttacactatagaaatagacatttttaaaggagtggaaatagataaaattatcaagaaaatattttattatgagcaactactatcaataatacctcaaggcacaatacacactgaaagattaatcattaatgatgctgaatgtcaatctctttcctgagtgttcttgatcatttcaaaattttgttgacacttctgatcaaatacaattggaccattcatgtttatacctcatgctgtggttgataaggagcttgaaggaaggagaatcagactggccatttatttgttcttcatttatgtttgtattgttagtgttatatttgaatcataaatttgaattctaggaattttgaaagccattcatgtttccaaagttagtatacttaaaaccagataatataatccataaacccccttagcatagaaccataaactacaatatgtcacttgacacaaggggtccagaaccccggggacgcagaccagtactggtctgtggcctgttgggaaccaagccacacagcaggaggtaagtggagggtgagcctcaccacctgagctccacctcttgctgtgctccacctgaggagtggagcacagatctgctccacagatcagctgtggcaattgcttctcacatagcaaaccctattatgaactgcgcacgcaagggatctaagttgtgtgctccttatgagaatctaactaatacctgatgatctgaggtggaacagtttcatcctaaaaccatccccacctcccccttccatggaaaaattgtcttccatgaaacggatccctggtgcccaaaaggttggggatcactgctttgcactaaaagcaaacaaatagatgaatattgttagctcctcgctgtaaaactcccattcttccttttccaaggacagatacagaacttaattgattcattcattcactcatccagtcagtatgtgtatgcatctaatatatgccaactgggtatatgacagtgaataaaccagacaaaaatgcttccctcttgaagctcttactctagtggggagataaagacaataaacaagataaggaaataaaatatatacataccatacataagctaagggcaatggaggaaaataaagcagattccagagtctccattataaaaaatacaacttttgcaaattggtctttagttcttattgagtttaaaaggatgtttcccttccacatccttcttcccactgtcttctgggatttttgcttcagatatgatggtcaaattgcttattataaattcccttctaagattctatgagttttaaatttgttttaattgttcacatgttgcattgaatgatgcaattgtactcttctagcacacagagctagtaaatttcctatatattgatatttaaagcctgtccttttatggagtattttgtgaccacctaaacccatgatgatttcttgtgtatacaccttcagtgcttggttcccatgtatttctctagtggtttcagaaaggtgagttttacattcctaatggattacagttcctaaaatccagtatgttcatactttctacttttattcctttccatttagtgcctagaaccatgccagaaaaagacataatttgactgtggatttaaccctcagatcacaaaccaatctcagagctttatttttttgctgagagttttaaataaactataaagtcaaatttaaacaattatcctttggaatcaacagaaccccacatttccttagctttccttagctgttcctattcccaaggatcacattcagagcactcttcttgagtgacagtgatgtgccaggtacttcacagaggtcatctgttttaattgtcacaaaagcccaagagaaagatactaactgttagaaatctagctcagaaaaagtagatgatttacctaaggtacatctagtgtgagtgacaatcagaacttaaactcaattcttctaagttgactgctgttttgattaaagcgcctgggctctcagaagtggactcttcctgggtgttagtcacaagggcttctcagaatttttctcctacatatgagacagcagatcatttctgcctctctgctaagataagccaagcaaaataatagattgtagaacaattaataatgcattcaaaatgccaaactcagcacactttctatcctttgtgaaaaattttgttcccattttgtccaaatgtctaataaaaatgattgtggaaaaataaaaacaatctttgatctgcctaaatgaaaataagaaccacaacttctagctctcagaacaaatcaaagttgtttttatttttaattaagtatgctaagcttaagtacattttctcttaaggtgtaattactaaaccatgatgatttctttttgtttattcatttaaaacacaaataaaagcagataatcaatagatcataatctaaaactagaggatttacaagttaataagcttgagtcaatagatattccataacaaagctttcaatgctgaacctgacataatttgctttgcactaagctggttgacttaatgctttaatttaattccaatattaactgaaaaatccaaagaaaaggggaaaatttaaatcctattatactgaaatatgttcaaagcaacaactcaatatcctgccacaactgcttaagtgtgccaccaaatgtctgcttaatcacctggtttctgattggtgataaccagttaacccgtttggagcctggtacaagtgaattgtggaagtttctcagtggtccattcatgcaatagcttttatcttagcctcaacagtcatcatattttcatctcataatgtctacttttcctgacttatggccaaattattggagttgtttttatttgaaaagcaatttctccttgtctcttgagattaccatccagcctgacctcccaaaaagcagaacagtaggcaggcctaggtcaaagaacagaagaaagcctttcttagttccctgaaaggaagatgtaagaagctatctgtatgaagaaatagcattagatggcatccatcatgcaaagtctggtagtactagtagaggtagtgagagggatgtgaggcaatatccagcataccttcaaggttatgagcacagactcaaaagacaggatccccccaggcaaatcctggttcttccccttacaattatatgaccatggacaatgtgcttcgactctcttttcatccatttccttatctgaaaaatgagggtcataatagtgtctatctcataaggttgttttaaggcttacacaatttaatatacataaagtacttgaaaagcactcattgttatcatcctttgagatactcttgaggcataaggaacttatgctaagaataattttgagaacagcagcatcagtcactgaatatagtagtcagatgtgtctttcagaagagttatgtgtgcacggccaaagtcctaaatattccatttgttaccatccttaaaatatcatttgtgaatttgtaactggtttttgctttgtgtcattgctggtcgactgcagtcagggtggcagtgttttggctgccccctaccatctttagttttctggtcccattagtgttgtgaccaagaacaagttagtgccctttgctcaagtaaatgggctagaagttaagcactgaccttttaccataggggacccttttctattctgaaagagaacttagaaaacagaacagaaatctcattgatttttacaatgcacattttttcatatttctccgtctctgaaattgcatgcatctaacaatcttataatcactgtagatggcagttgttacatacttgtcatttcctgtgcctgcacaaactctcgtcacttcacttgagttctgtgcaccgttggtacgacacacacattgagtttaattgccacttaaaatggcttcaaaaaatcatactatgatttggcattaaaataaaaagtatacacaaaaggcacagaaacagtcacttcatataaaacttaaaaagaaaaaacaaactatgcccatgcaagtctaaagaagtctttcaataagtataaaatacacatctaagtgataaaggaatcactgtgttcttgttgaattagcagcatatttttctctttcttagggatacataaaatagtttttaaaaaaataacagtgtgtttaaatagatgaaatcctggaccccaaaaataggtgtgttttataataaatatttttaaaacagctagcatattgccaataagataatgtatttaaataaaagataatttattcattccgcagacatctatagagcacccatatggtgccaaacatattttgtatccctagtccctgtcctctaagagttcaaggtctagtggggagaaaaggcaggtaaatagatcaatctaatataaaaatgccataaacagcagaaagaacagagaagagagacaagtaactcagtctggggagtcaagacactcttccaaatggagatgacattaaatttgtattttcaaggatggaaatacatcctttccaggcatagaagggcattctaagaaaagaggaaatcatgaacaaaagcgcagcctcattgaagagtgtgttgtaactgggtctgagtcatgagtctagggacagggtgtgaatgaaagaggcagaccagggagaggctaaggatgtgcccaaagagacaggctgcaggagattttgctggtaagggctggcaatcaaaaccaccctgcttcctaaccaggtctaggctctggcatcactctgacttttaaattaggaaagttagagcttgattcttgcacttgactctgtcaatgcattaggatctaggagagatggtaagtgatgttggaaagcagtccaaagttcataagcagttagctatttccatccaaggatgccatgatttcctctcctgaaactaagtgaacagccatgggtaaaaatgaactgaaggcagaacatgggcctctcatgtaaaagcagaagtaggggattcccaggcaagatggccaaatagaaacagctccagtctgcagctcccagtgagaccaacacagaaggtgggtgatttctgcatttccaactgagatacccggttcatcccactgggactggttggacagtgggtgcagcccatggaaggcgcagaagcagggtggggcgtcgcctcacccgggaagtgcaaggggtcggggaactccctcccctagccaaaggaagccttgagggactgtgccatgaacgactgtgctatctggcccagatactacacttttcctacagtcgtcacaacccacagaccaggagattccctcaggtgcctacaccaccagggccctgggtttcaagcacaaaaccaggcagctgtttgggcagacactgaggtagctgcaggagtttttttttccataccccagtggcacctggaaccccagcaagacagaactgtccactcccctgaaaagggggctgaagccagggagccgtgtggtcttgctcagtggatcccacccccatggagcccagcaagctaagacctactggcttgacattcttgctgccagtacagcagtctgaagtcaacctaggatgcttgaccttggttcggggagggatgtccaccattatggaggcttgagtaggtggttttcccctcacagtgtgaacaaagccaccaggaagtttggactgggcagatcccaccacagcaccgcaaagccgctgtagccagactgcctctctagatttctcctctctaggcagggcatctctgaaagaaaggcagcagccccagtcaggaacttagagaaaaactcccatctccctgggacagagcacctgagggaagggctggctgtgggtgcaacttcagcagacttaaacgttcctgcctgctggctctgaagagagcagcagatttcctagcacagcacttgagctccgctaagggacagactgcctcctcaagtgcgtccctgacccctgtgtcttctgaaagggagacccatcccagaaggagttcatagacatctcatacaggagagctccagctggcatccggcaggtgcccctctgggacaaagcttccagaggaaggagcaggcagcagtctttgatgttctgcagcctccactggtgatacccaggcaaacagggtctggagtggacctccagcaaactccagcagacctgcagaaaagcgccctgactgttaaaaggaaaactaacaaacagaaagcaatagcatcaacatcaacacaaaggaagacaatgaaacaaccccatccgaaggtcaccaatatcaaagataaaggtagataaatccatgaagatgagagtaaaccagcgcaaaaaggctgaaaattccaaaaactggaatgccttatctccaaaggatcacaactcctcgccagcaagggaacaaaactggacggagaatgacttcgacaaactgacagaaataggcttcagaagcaaggtaataacaaactcctccgagcaaaaggagcatgttctaacccaatgcaaggaagctaagaaccttgaaaaaaaaggttacaggaactgctaactagaataaccagtttagagaagaacataaatgatggagcagaaaaacacagcactagaactttgtgaagcatacacaagtatcaatagccaaatcaatcaagcagaagaaaggatatcagagattgaagatcaacttaatggaccagtgcaagaagattagagaaaaaagaatgaaaaggaacaaacaaaggctccaagaaatatggggctatgtgaaaagatcaaacctacatttaattggtgtacctgaaaatggcaaggagaatggaaccaagttggaaaacacacttcaggatattatcaaggagaacttccccaatctagcaagacaggccaacattcaaagtcaggaaatacagagaacactacaaagatactcctcaagaagagcaaccccaagacacgtaatcatcagattcaccaaagttgaaatgatgaaaaaaatgttaagggcagccagagacaaaggtcgggttacctacaaagggaagcccatcagactaacagtggatctgtctgcagaaaacctacaaaccagaagagagtgggggccaatattcaacattcttaacgcaaagaattttcaacccagaatttcatatccagccaaactaagcttcaaaagtgaaggagaaatgaaatattttacagataagcaaatgctgagagattttgtcacaccaccaggcctgcattacaagagcttctgaaggaagcactgagtatggaaaggaaaaacttctaccagccactgcagaaacataccaaaatgtaaagacgatcaacactatcaagaaactgtatcaactagtgggtaaaataaccagctagcatcataatgacagaatcaaattcacacataacaatattaaccttaaatgtaaatgggctaaatgccccaataaaagacacagactggcaaattggataaagagacaagacccatcagtgtgctgtattcaggagaccaacctcacgtgcaaagacacacataggctcaaaacgaagggatggaggaatatttaccaagcaaatggaaagcaaaaaaagcaggggttgcaatcctagtctttgataaaacagactttaaaccaacaaagatcaaaaaagacatagaagggaattacatagtggtaaagggatcaatggaacaagaagagctaactatcctaaatctatatgcacccaatacaggagcacccagattcataaagcaagttcttagagacctgcaaagagacttaaactcccacagaataatagtgagagactttaacaccccactgtcaatattagacagatcaacgagacagaaaattaacatggatattcaggacttgaactcagctctagcagatctaatagacatctaacagacctaatagacatctacagaattctccaccccaaatcaacagaatatactttcttctcagcaccacatcacacttattctaaaactgaccacataattggaagtaaaacactcctcagcaaatgcaaaagaatggaaatcataacagtctctcagaacacagtgcaatcaaattagaactcaggcttaagaaactcactcaaaaccacacaactacatggaaattgaacaacctgctcctgaatgactactgggtgtagaatgaaattaaagcaaaaatacatacgttcattgaaaccaatgagaacaaagatacaacataccagaatctctgggacacagctaaagcagtgtttagagggaaatttatagcaataagtgcccacaagagaaagcaggaaagatctaaaatcaacaccctaacatcacaattaaaagaactagagaagcaagagcaaacaagttcaaaagctaccagaagacaagaaataattaagacgagagcagaactgaagaagatagagacatgaaaaacccttcaaaaaatcgataaatccaggagctggatttttgaaaagattaacaaaataaatagactgctagctagactaataaagaagaaaagagagaagaatcaaatagacacagtgaataatgacaaagggaatatcgctactgatcccacagaaatacaaactaccatcagaggatactataaacacctttacataaataaactagaaaatctagaagaaatggataaattcctggacacatacaccctcccaagactaaaccaggaagaagttgaatctctgaatagaccaataacaagttctgaaattgaggcagtaattaatagactaccaaccaaaaaaagcccaggaccagaaggattcacagccgaattctaccagaggtacaaagaggagctggtacaatttcttctaaaactgttccaaacaatagaaaaagaagaactcctccctaactcattttataaggccagcatcatcctgataccaaaacctggcagagacacgacaaaaaaagaaaatttcacaccaatatccatgatgaacattgatacagatattctcaataaaatactggcaaatcaaatccagcaacacattataaagcttatccaccacgatcgggtcagcttcatccctgggatgcaaggctggttcaatatacctaagtcaataaacataatctatcacaaaaacagaaacaatgacaaaaaccacatgattatctcaatagatgcagaaaaggccttcaataaaattcagcaccccttcatgctaaaaccactcaataaattaggcattgatggaatgtatctcaaaataataagagctatttatgacaaacccacagccaatatcatactgaatgggcaaaagctggaagcattcccttggaaaaccagcacaggacaaggatgccctctctcaccatttctattcaacatggcattgaaacttctggccagggcaatcaggcaagataaagaaataaagcatattcaaataggaagagaggaagtcaaattatctctgtttgcagatgacatgattgtacatttagaaaaccccatcatcttagcccaaaaatgccttaagctgataagcaaattctcaggatacaaaatcaatgtgcaaaaatcacaagcattcctatacaccaataatagaaagagagccaaatcatgagtgaacttccattcacaattgctacaaagaaaacaaaatacctaggaatacaacttacaagggttgtgaaggacctccccaaggagaactacaaaccactgcacaaggaagttaagagaggacacaaacaaatggaaaaatattccatgctcatggataggaagaatcaatatcctgaaaatggccatactgcccaaagtaatttatagattcaatgctaccccatcaagctaccattgactttcttcatgaaattagtaaaaattactttaaatttcatatggaaccaaaaaagagcccatataaccaagacaatcttaagcaaaaagaacaaagctggaggcatcatgctacctaacttcaaactatactacaaggctacagtaaccaaaacagcatagcactggtaccaaaacagatatatagaccaatgaaacagaacagaggcctcagaagtaacaacatacatctacaaccatctgatctttgacaaacctgacaaaaacaagcaatggggaaaggattccctatttaataaacagtgttgggaaaactggctacctatatgcagaaaactgaaactggacccctttcttagaccttatacaaaaattaagatggattaaagatttaaacataagacctaaaaccataaaaaccctagaagaaaacctaggcaataccattcaggacataggcatgggcaaagaccttatgactaaaacaccaaaagcaatggcaacaaaagctaatattgacaaatgggatctgattaaactaaagagcttctgcacagcaaaagaaactatcatcagagtgaaaaggcaatctacagaatgggagaaaatttttgcaacctatccatctgacaaagggctaatatccagaatctacaaggaacttaaacaaatttacaagaaaaaaacaaataacctcatcaaaaagtgggcaaaggatatgaacagacacttttcaaaagaagacatttatgcagccaacaaacatatgaaaaaagcctcatatcactggtaattagagaaatgcaaatcaaaaccacaatgagataccatctcacaccacttggaatggtgataattaaaaagtcaagaaacaacagatgctggagaggatgtgaagaaattggaacacttttacactgttggtgggagtgtaaattagtttaaccattgtggaagacagtgtggtgattcctcaaggatctagacccagaaataccatttgacccagcaatcccattactgggtatatacccaaggcattataaatcattctagtataaagacacatgcacatatttattgtggcactattcacaatatccaagacttggaaccaacccaaatgcccatcaatgatagactggataaagaaaatatggtacatatacaccatggaatactatgcagccataaaaaagaatgagttcatgtcctctgcagggacatggatgaagctggaaaccatcattctcagcaaactaacacagaaacagaaaaccaaacaccacatgttctcactcataagtgggagttgaacaatgagaacatatgggcacagggaggggaacatcacacactggggcctgtcaggggctggggagaaagaggaggggtaacattaggagaaatacctaatgtagatgacgggctgatgggtgcagcaaaccagcatggcacatgtatacctatgtaacaaacctgcatgttctgcacatgtatcccagaacttaaagtgtaattaaaaaataaataaataaaagcctgggtgtggtggatcatgcctgtaatcccagcactttgggagtccgaagtgggcagatcacctgaggttgggagttcaagaccagcctgaccaacatggagaaacgccatctctactaaaaatacaaaattagctgggtgtaatggcacatgcctgtaatcccagatactcgggaggctgaggcaggagaattgcttgaacccgggaggcggagattgcagtgagccgagatcgtgccattgcactccagccaggtcaacaagaacgaaactccatctcaacaaaaaaaatataaataaaaaattttttaaaagcagaagtaggattacagaaagcagagaagcccaaaagatttgaatgttcactgacaaacacagcaataaagtatttgatattgcaggcttcatttgaagtaaagcttcaggaatacctggaaaccaagctacaggtggcactcagctccctaaccagcctttgccaagaggaggggtctttccagagacaaccatagagagtaatctttagccatgttatcgtctaatatcaaaaatagggggcaggccaggtgaggtgactcacacctgtaatcctaacactgtgggaggccgaggcaggcagatctcttgagcttaggagttcaagaccagcctgggcaacatggtaaaactacatctctacaaaaaatacaaaaaaaaaaattagctgggcctggtggcacatgcctgtagtcccagctacttgtgggactgaggtgggagaattgcttgagcccaggaggtcaaggctgcagtgaacagagatcatgccactgcaccccagcctgagtgtcaaagtaagaccctgtctcaaaaaacaaacaaacaaaaaaaaaagagggtgtaatggaagtgttttaatatgaccacggcatcctctcactgagatctgctaccatttattttattttgtttgtttagagacaggtctcactatgtcacccaggctggagtgcagtggctccatcatagctcactgtatccttgacctgggctcaagtgatcctcccaccttggcctcccaaaatgctggttagaggcgtgagccaccatgcccccatttgtaatttaagctgataaatgagagcaggggcacaagtctgtatccgctaactcttcagcaacagctgacccaaggccagcaaacccattgcatagccaacaaccaaccagatcctgtctttctgaagacacacagagacagtagtcagatggttatgactaataaggctgtaaggttgtttagactgacaattggtagccatgctgggcaaaagggaaagaaagaaaattaagagaaagggaaaagagagagaagtgccatgcagcccctgagtgacagagagagaaactcagttctgacagttttccagtttcaaaacccaaacctgtaaagttgacccttgaacaacacaggtttgaacaggtccacttacccatagcttttcttctgcctctgccactcctaagacagcaagagcaattcctcctcttccttctcctccttgacctattcaacaagaaaatggcaaggatgaagacctttatgacctttctcttccttatgattttcttaataactttttctctagcttgctttattgtaagaatgcagtatataatacatataacaaacaaaatatgtgtttgttgacagcttatgttgttggtaaggcttctgttattagtatcctgttagtagttaagttccgggggagtcaaaagctatgtgtaggccaggcacagtgggtcatgcctgtaatcccagcactttgggaggatgagacaggcggatcacctgtggtcagaagttcaagaccagcctggccaacatggggaaaccctgtctctaaaaaaaaaatacaaaaatttgggtgtggtggcacacacctgtaattccagctactaggaggctgaggcaggagaatcccttgaacccaggaggcagaggttgcagtggccaagatcgttccactgtactccagcctgggcaatagagagactctgtctcaaaaaacaaacaaacaaacaaacaaacaaaaacagaaagttatgtgatatgtagacgtttgcctgtgtaggacattggatcccctaacccttgcattgctcagaggtcagctgtagcttctgtacaggcttgggttctatacttgccttttctcttccttacaaaaccaatcaaaatgagtttcttttccctgtaactaaatttccttgactagaatattgattactgccaattcccacctttcctgtaagttgtaagttttagaatctggttgtttttttttattgggaaatacaattgatttttgtatgatcctaaaattgctgaactctataattgtttatttttagattctgtggaccttttaggtagttaataatcatatctcatgcttcaaaacccatgtaccttgtgttagaataagataggataggataggctctggtaacaaataaaattccaaatctcactacctaatgcaataaaagtgggaaagtcaaaggtggatttggctgcccttctccatcttatatcagtgtcagatcatgataggggaagagcatgctgcagagttctgcaagaagcttttaaggtccagacctggaaatagctgacattccttcttctcacatcccattgataagaatgtctcataacctctctatttaggggcagggaaactagcaactgcgaaaaaagtaaaataaatgaatatttggtaaattataataatctctgctgcatagctctttttatttccttatcttacattgcctaggattaccactacaataataaatagaatgcatctgtcttatttgttatattaacaggaagactgctaaagttttatcattaagtatgattttgctatatgagtgctgaatttttctcttgagatgattaaatgtaaaacaacttttctaagggctaaatcctatatggtcattgctctggactgaatgcagttgcccactccctttccaaatccttacaatgaaatcctaaccctcaatgtgatgttattaggaagtggtaaggggacaaacaagtgaagagacagatacactagagtataagatctatcaagtaataaaggtggacctgtgagtaaattcaaaccatttttctctcttgagtagccatgcttatgacaaagaaattttgaatgccttgtgggttgtttgtttgtttgttttgagatggagtctctctctgtcacccaggctggagtgcagtggcgtgatctcggctaaccgtaagctccgcctcccgggttcacgccattctcctgcctcagcctcccgagtagctgggactacaggtgcccgcaaccacgcccgtctaatttttggtatttttagtagaaacggggtttcacagtgttagccgggatggtcttgatctcctgacctcctgatctacccgccttggcctcccaaagtgctgggattacaggtgtgagccaccacgcctggcaagaaattttgaatgtcttgttttcaacaaatagttttaatttaaatcgaaaagagtgtgtaggtatgagttgcgaatttgtaattcatttgcgattctggtattgatggattgtcttatcttgtacaggtcatttgggccctatggactttaggctcaacaacaaaatcagacagttggagtacagtgccagtcacaatttttagactgtttaaccctaaatgtctttctaataggccttatttatatgagaacattttatagttaaccacaaatattttgtctgtgtttatcaagagttacaagcatagcagccctttctttactgaataaaagttcaaacaaattggattcatctttatttggagctgccaattaaagtgggatatagtatagttaagcagtactcaacatgtaggccactaatctcttagggtcccaaacactctttcaggggctctgccagggaaaaactatgttcatactaacagtaagaacttacatgtctttttcaccttcatccccttcatgagggtacactacagtggagttttccagaggctccatgatgtatgaggatgtagtcactctgctggctagtcgtatacatgtctcagtattcttttcctttaaacacttctctactttaattttcaatatggtactattgatcgatataaagatcagaaacaaaagttctttgggatcttcagttgtttttaagaaacaggggtcttgaaatgaaaacactggaactactaatacacttcacaagtacattttacctccacatagcacagaaataaaatcataaccctgtctcttgtcagcagtatgactctaggtaagacatttaacttatctaagcctcaatttccttatgtataacaatacaaatctcctagcttcatgtgaagatgaaatgggatacaccaagtctgacatagtaggagcaaaaactttgctcacaaataatctaccttaggaaggatagacaagaaaatggtaaactggttgggtgcagtggctcatacctgtaatcccaacaatttgggaggccaaggcaggtggattgcttcagcccaggagttcaagaccagcctgggcaacttagtgagaccttgtatccacaaaaaaaaatacatatgtgtgtgtgtgtatatatatatatatatacacatacacacacacacacacacatatatatatatatatacacacacaaaaattagctgggcatggtggcacacacctgtggtgactcaggaggctgaggtgggaggattgtttgagtcttggagacagaggttgccatgagccaagatcatgccacaatactccaacccgggcaacagagtgagactctgtctcaaaaaaaaattaaaaacgaaaagaaaatggtaaataaataacttttgttaccataagggaggagaactaaacaactggggcatgggggaggagatggggaacttttcattgttgctgcacccttcacttagaaggtccagtttatgaaaagtaataatttagttaaaaccttcaaaaatgatttttaaagaatttccctgctcctcatagatatagcctggtagtttacataccacttcattttctatgaagtactgttgttgcaaatttatctatgcaaagagctaagcatgcaatgattgttgctgtgggtataaaatactgctttgctaaggatactgtagctaactcacagttaattggctgaggcctgagcacacccatatcagtttgccatatacagatttttggttaacttgatttccatatgcaaagtgagaagaaagttctaattcatatatatatatatatgtaaaatatctttctctcctgagtcatcaatctctacctcattattgaaaaattgccatcaatataaaaatatactcctggtatctcccattttttaaatatgtgactccacgggcccctccagctaccatctcctgttcctgttcccctttacagtttacagccaaacttctcaaaagaatatattactattccctgtttctacctctacacatctgttctcccttccacccactccaaccaggtttctgtccttatcactccattaaaaggctcatatcaagacgatttgccacgaaatcaagagctcttcctatgcacagcttccttaacatttcagcagcatttgacactgcttaccacacttctttaaaaaataccctcttctctcagtttcaaggagaacacactgtattggttttcttccctttattgtcctggtctcagcttctattactgatttcctttcggctgctgtccaagtcagcctcatcctgcatctgccactgagtttggtcctgagctctctcttctacttgacctacactctctccttagactattcctagactcattcaagtctacttcttagacttcactctacattcgcttcttcaccccagcccttcagcttaaattctgtccatattcactgataatacaaatacttttgaacacttactctagcccagccacaattagaggcatttggggtttagagagaatgaagtagatgcaggcctttgactctgtggagtttacattctggcaaggaaagacagacaacaagcaataatcataaaaaaatatggtatgttagaaggtgatgagtgcttaagaaaataaatcaggataaaaagaatcaaaattgggaggagacagggaggagagtgggtcagttgcagttttaaagaagagtggctcattgagaagatgagctgaagttactcatgcaaacctatgcataaagtgggttgcaggcagagaaaacagccagtacagaggcctcaaggcacgagcttgtttagtatgttttaaaattttcaacaagactagtgtggctgcagtgcagttttcccaggggaaaatgataggagacaatgtcagaaaggaagtggaagggtgggcagaaagaacaggctttgattatgaataacttgaggaactagaacagggttttgagcagaggagtgacatgatctgacttgtgtccaaaatacacttttgctatgtggacaatgaggatttaaggttaaaaataggctaactggctgggcacggtggctcacacctgtaatcccagcactttgggaggccgaggagggcacatcacaaggtcaggagttcgagaccagcctggccaatatgatgaaaccccatctctattaaaaatacataaattagcctggcctgttggtgcttgcctgtagtcccagctactcaggaggatgaggcagaagaatcgcttgaacctgggaggtggaggttgcagtgagccaagaggctgcactccagcctcagtgacagagcgagattccatctaaaaaaagagaaaaaaaggcaaactgaggctactgcagtgctgagagtgggaaagtatggcttggatcagagtggtagtagtagatgtggtgtgaactggtaggattctggatgtatcttgaagttaaataaatccagtcctatttcctaatgagtagagtagatgtgaaaaaaaagagaaaatgaatccaaagtttttggcctaaacaactggaagaatgaagtcgtcatcaactgaaaaaaagggaagactgcaggtgaagcagcttttctaggtacatcagaatcatttcagtcagggagactgaacactatgggttttgagatagaaagtttattattattgttcattagagacagggtcttcttatgttgcccaggctacactcaagcttctgggctcaagcaattcttccaccttagccttccaaatagctgggactgcaggtttgcatcaccacacccagctaaagatgagcgctttctctaggaattagaccttacgcaattgtgggaatagctgggaaagtgaagatttggggaggagagtaagaagatgggtaagggagttgccaccatgcccattcaagaagccaaggatggccagccaccttagtgtccctaccacagatgcctatggagaggtctatggaaagcaactcctctgtttagctaccatctctgtggggccagcactaagtgtcaggtggtagacctgggccactattggttaaagagtcagcagctggaaagaagagtcagattggagtagaggagaatgaggacaatctggaacccacttgcacctctgtgtctattcatcttcacatctaacttcaaccaacttcgaagagtaatggccactgatttactttcattctccaaattgtatgtaaatgtatctttaatccagaactagatagagaagatatattactgctatatataacaaagtacaacaaacttagtagcttaaaaacaatttctacttgttatctcacagttcccctttgtcaagagtctcaggccttttgttcgaggtctcataaggctacaattagggtgtctgttgggctgtgttctcatccggaggtttgaatggagaaacatttacttccaatctcattcaagttgttagcagagttcatttctcttgtgtgggaatgagagggaggccctggcttcctgttggctgttggccctcatgtcctagagaccacctagttcccctccacaggggtccttcacaggccctctcatagcatggcagtttacttcttaaagaccagctgaaggatttcactttcagtctgctgagatggtgtctgccatatttatggcagtgacatcctagagttttgccattttctattagttagcaacaaggcataggccctgactgcactcagggggagggagaatcacacaagggcatgattcattgcaggggtcaccttaaggtgtgtctcccacagaaggaattctgagatatgcagtttcaccttaaccaatctgacataatacaaacttcaaaaaagggaaaatcaagagatcatatggagacttgttaagtttcagatgtattagacatccaaatgaagaggttaacaagacaattggatacaagactggattttgggagatatgtccaaggaccctcaaatgtgtattcctaattcagtctcttcccaaaactatagtttcattggtctgtctacttgacatcttgaacttaacaagaccaaagttgttccttcccttcccaaatctgttactgctcagacttctacatctcattaaatggtaccctcacctaccctttctctcaagaagaaaaacctaagagtcgtccttcattcctctctttcccttgccttctacattcaatccatcataattctattggttctacattcaaaatataaatctatccccttaattctatgtctaccattaccaccctagtccaagccactattaccccttcctggccttcagcaaaagcctttgaatgtctcccctccctctcttgacccatgttatgaaatggattgtgttcctcccaaaatgcatacactggagccctaacccccaaggtgactgtatttggagatagggcctctaggaaggtaattaagcttaagtaaggtcataaagatgggaccttcatcctataggattaatgttcttataagaagaagagacaccagagatatctctctgcatgcacacaaagatgacacggaaacacatccagaagacagctgtctataagccagaagagaggcttcaccagaagccaaccatgaagacaccttgatcttagacttctaacctcaagaattgcaagaaaatgaacttctgtgtttaaagcaactcagtccatggttctttgctatagcagcccgagtagacaaatgcaatggcctccatatattgttcacacatcagccagaatgagttcttcaaaacctagattaaattgtgtcacacccttgtttacaggccttcgatagttttccactgaaattggaatcagacttgaactctttaccttggcctccaggattgataccatctagctcctgctcatccttttgaccttctcttgggccattcttctctccatcacccagcttggtcgcactagctcctttctgtcaacaaaaacaccaagtctgttcccatcttagagtttctgttctgctcttgctcccaaaactttgtcccctgattcttcacacagatggtgtttttctgcactcttgcctaaatgtaacttcttcaaggacctttcttacccgcccttgtaatcaagaatttcattcactcttccccaatacctaagcccaaacactaattagtgcaccaccctacttattcccttcataatttaccacaatttccaattctctctctatgtcttgatctctctatctccctctgtttatatattgcccatttgtcctcctttataatgtaaaattcgggaaggtaatgaccttgcctcccttgctttctattgtatcctcagagattaggagcatgcctagtgtataagaagctctcaatacatgtgtgtttaatcaaggcttaaataaatctaaagctatggcccaaatgaaaatttttatatgagttttagtacagttttgccactatttccatagaatagattatcagagtgaaattgctgggtcacagtgtatgcacatttttaattttgatagatcagaagtactgctttttaatatttagtgtgactgatttgccactttaaaatttaattatcacaaatttaatttttttcctcttctcctttgaaaaatgaggcatttcaaaaccatttttcccccaatgtttttatggtaactgaagcatcattgttcattttgcaataactctagcttttgctttataggttaaattgatacagccaatttgtctataaagaaaatgtctgtgaattgagtcttctttttgaattgacccctccattacaaaatgaatgatgtattctaaagagaggaaaaaaaaaaccttctcccttttcacgtatcattcttcttttctgagtgtagagagttgttggagtaaaagcattaaagtgatcccagtgttaatatgtggatcctccaagctgaacattttaagtttgaaatttacaattgttataacaattgtcccctgcctaatccattaggtgacagcattagctagaacccagagctaggaatgctttaacacttatgagtacatttgagttggcctcattgttacccagtcgtcaatagtgtccttaacatttccagctgcctcatcactgtttgatatgtacaaggggctgggacaagggtgtagagggttccactcaaacatgtccccagtatcaggagaaaacacacttcaggaaggcatggttctgatagtgggtcaggaaagaaaataggaaaattggttttaacaccattcagttattatacttcctgcctcaattgaaatcaaaagaaaaatccttgtgtctaaagaataattacaaattttgaaatagagtgaacgttccataaagaaaattttaaatcttttttctaagaaaatacttttcctattaccttgtgcaaatggcaatctatacttattggctgaataataattgagttaattaattaattcctggcagatttattatttcattagtcactgaccatgatctataccacgatagggtgaaatttaaaagttcttccattattccttcaaattgcattgcagagctcttcacacataattaggtcttaaattttttgcctaatgttacttattgtttcctaacaaatgcagttcaaaaactttagagtgacattcacagccctctttagtcttatcacaatcccctttccagccacaatccctactattcccctgcaaccatcacacttctgctttgttgaactgccacccaggtatctccagaactttctactgttccttcttctaatccttcatctatttttatctgctcaaattctacatctttcctgacctggatcaaatgccacgtctcaattaagtcttccccaagtcctcaccccctttcttctgaataacaagtatttccttagtatttctctggtgcttattatagcactgccacactgaattgtgtgtatgtatatacattattgatttgctctattagattataagttcctcagagtcaagagtctgtgttacccatcttgtatcttccattgcaattttatagagtcttttgcataaaagatgctcaaaaatgtttaaagaagtaaaccagctgctgagaaactgctaaatgtttgcactgagcattttggcagctgtgtcatcccacttggtgatgctgcctagcacatacacactaaaacaataggcctgaacactaaacaataggccatggtcctaaagggtattttgttctacctttcttgtattgtgagttgatctttgattccggagcaactctgcatgtacgtgtttgctgtcaaaataaatgtcttttttgtctcaccagctgagatacatttaggtgaagatggcactggtaaaggaagtgtgcaggtgaagttggtgaaaatgttctgacaatgtttatattttgcaggcttggaagtctcatgccaagtgaaccatggataagtattcaagtttgatatttgcctaatgcgtggtaaaaaaataataataataatttctgtatcaagactgatttgatggccaggctctgtggctcatgcctgtaatcccagcactttgggaggccatggcgggtggatcacctgaagtccgaagttcaagaccaacctggctaagatggtgaaaccccgtctctacttaaaatacaaaaattacctgggcgtggtggcgggtgcctgtaatcccagctactcgggagactgaggcatgagaatcgctcgaacccaggaggcggaagttgcagtgagctgagattgcgccattgtactccttgcatttcagcctgggcgacgagagtgaaactccatctcaaaaaaaaaaacaacaacaacaaaaaaaaaaaactgatttgaattttgcaaaatagtattagacataaatatgttgatcaacttttggggaacttaaaggttaactttataaatggagaggaaaaatcgtcctgcagaatccacgcctcaaattatctggctttcaaaaatctagaaaaatattttgtgttgatttgtctacattacgacatataaaagtcatccaattgcctggatgtactctatccaaagtcatggcttttagataacagttaatgggagctcgaactgcttctcacattttatttgtaatctaaatcagaaactctaggtctcaggtataatcattccttatcattaagacaaaataaaatataattaatgataaaggatctcggcagttcaacttaagaatacagaggttaatatacttaaatctagattcttctgaagttctctttgcacaaaaaggtgaatttttgatgtgacttattctctggttcttggtattcatcataactaaggaggcaagggaaccccgtgacttggttgggatgcagaagccaaaactcatccatttcaggataaagagcccaggataagggagaatcataaatgaaagacaaagccagaagaaatcccactggcttagaatgaagttgatggtgaccaggaagattaaccctttccaaaatataatatggacacgtaatactctgttgatgaacacaagagtgcctatacatcattgttttggttcattactgggagcagggtaaaaagattcctaaggtctacagtaagtgagcttagtgaaaatacaccccaaagaccagagggaaagctctggaaactgctggatcatcagatcaatagactcaaagatgactaagttgggaagctttatgcagtttaaacatttgtgcagggagtatccccacacagccttttattgacagctacagatcaatggtaatttttgatcattttcaacttacataaacctattgaccccatggccacctttggggcacttcaagtcatcaaaaataatcagaggagatggtgtaaaattgtcagactgctgaagactccaagtagttgcatatgtccccaggagctgagtcgagaggttaaaatatagttcaaattgccagcagaacctcaactgacagagtgttccagagagtcttgtctttatgtctcataaaatgaggcactgatttgtatccaaactctgaccttcatgcatataaagttaaagaaggaaaaaagaggctgaatcccattgaagatattagattgcaaagaatggattattcctagtaaaatatttcttcctgtttttctttgttgagtcatcttcttcatctgctgcctaacaaaagtagctgacatgcttgtagaattacgtacaatatggacgtggacatagaatgaacaaagacaaaacagaagcaagtgcaaggtggcaggccagaagtcagggacaacaaaaaatgtagtcaaaaaaatcattaggaagagtgaaaggaaggaaagagcaaaataatggcaataaaggggaagaagtaagagtattgaattaagataatctctatagaggaaaaggagtgagagaagaaggaaagggtgaataagaagaaagagaaaggaagaaacggaagaaaagtgaagcaaaggagtaaaaggaaggaaaatcgtctttagtgatgacttttcctagttagtaagacagaacgctacatctccaaaggaaggaactgaatccaaaacatctaagatccacagtgctcaagcaaatatcctaaatttaagaaaaataacaagaaacttagtacgtaaatgagagccaacccaattcacagagtgaactgcatccaaattttgcagcaggattctaaaatagtgaactttgatgttggaaattcattcaggagagaataatataaattatttcctaaaacgtcaaagaataaattggcaaggattatcttgtcatttttatgttttcttcattttttaatatagcttttactaaacattgacaaaaaccatggctattgtttagatctatttaaggagtctatatgtggtttgtgtgtgtgtgcgtgtgtgtgtgtgtgtgtgtgtgtgtgtgtgtgtgtgtataaaactattcaggaataacaaagtagccagatgcagcagtggcttgcacctgtaatcccagcacttttgcgcagccaaggcagaagggtgacttgagctctagagttggagaccaacctgggcaacatagtgatacccaatccctacaaaaaaaggaaagaaagaaagaaaagaaacattttgttttaattagccacacacggtggtacatgactgtagtcccggctactccagaagctgaggcaggagaatcacttgagcccaggagttcaaggctgcaccgagccatgatcatgccacactccagcctaggcaaaagagccaaaaaataagaataataataataaattaaataaataaataaataatgtaatatgagaacttgtcctcagtataatttcatgatacagaaattacttttacatcccaacatgtggttatttctctcccttttttttttagatacatgtagaccaggttaagcaaaacaactgttgtaatgaccctttgtaggagtatacccctaaaaattttctgtgccaggcatgcatgaacttcagcttgcaacctacaggccatatttctatattagatggtggaggtttggaagctagggcattttgaatacttctgctttcaaggatctgagccgtaaatgtttattaaacgaatctataatgaaatcagttttgttatttttttaatggttgcctggagtgtgttggatgactgaatgccagttgttaatcattaagtactcatgttaccaaaagtgtttgatagtattgccatctaggggctgaatggaattctcagctctgaaataaattataattgagcaggtgcagctattgacaatatacatatgtttttgctttatagcccacatgcttttcatgtttcttatgacaaaagcttatgaaaaaatgtcccccagcagcccaccttttttatatataatctgttagaggtgattactatttgctttggagcgtatgcttttttggcatctattactgaatattctgaacaaagaattattcttttttgcattattaatcttgcccatgtttgccctatttccacagaaaaggaatcatttatcagaaaagagtgtttgtaatcgggacttgtagcatcttcagatttaatattcattatggtcattctagttctgtgctatatttatctaaaaggccaatccaatgttatggagaaataagtttttaaatatttatgatctaacttttaatattttaaaaaagagaaattagtatttctgtaaaatttgtttcagagtctgattgctcagcaaatgtttaaatattaaaagatttcaagaggttagcgtgtaatatcataatgggacttattgaaataggaaaattgactttacaagtttttgatatgtgaaggaaattgtattttctctgcctatgtttaacacataacaagaaataacacagttaaaatatacagccaataatgtcagaaaacagcaccaaaacctatttctacattgttttgtttttgtctaaccagtttgtttggaaaacaattctgtttgattttgtcatcttgttttagattttatccaaaatgatatttggatgcccccacacataattttttctgatgttcttgggtgcctactttcagaaataactttcactactccactttatattcttcttcccttgttcatcaaggaaagaagacaattgaagaccatgtatcacattcaaacatctaataaaccaaagcagatcattgaatgtaaatatcctactaacccagtcaaaactttctcatgatttcttatatccaatggggatggtacgcaacagaaaatgccagtgtgtgtgtgtgtgtgtgtgtgtgttcgtgtgtgtgtgtttacctatgaacacattactaccccacttgcatacataattcctactttaaaaggacatatcctttcagtccagatgtggaaagagcaccccagggcctttagaaacattaggattcttagctccagtttagttatgccaaatatgttaatgctgctctccaagcagaaaaacaaacaaattttaaaaatcctaattaggctatccctttttttcttttcttttaaagcaacaaagaccaaattctccaagcctagctaacaattacttttggtaggtttcatagttttacttatggtgcttttaacaaatgaaaatatttttatatctatattaataatagacttctctaagggtgtttgtacatgtatagttgaattggcttgttactgttttcttgtgtttatttgttttattgaattcgtaagatatatatacatgccaagagaatgagagagggagactgggaagatggagagtcttgtgtacaaacagatttggaaattaggggtgttcaggttaactctccaaacccttaatattaacctggcaggcaattatcccagtctcagacatgcagcttggcaccactgatttccattttgagctggatgcagcactgatctgaagcatcatgttttgtttttttttttaatgtttatatatcacacgctttgggctgcaagcactgaaaagtcaaggatgctatctggtccactttctgagtgtctgaaatcatacaacattgggtaatatattcacggtgtcaacaagaataagaaaaaatgcgttgttttcttaatgataattcaaaactctgctgtagtgtttgcgctgctgttgcctacaagctttggccatgaggttcagagaatgactttccagcaatattgtcagtttcaaaaaaaaaaaacaacaacttaacctgttaattttcttacagggaacaagccatcaagcccacctgtacgggttagaaccattcacaacatatcgcattggtgttgtggctgcaaaccatgcaggagaaattttaagcccttggactctgattcaaaccttagaatcttccccaagtggactgagaaactttatagtagaacagaaagagaatggccgggcattgctactacagtggtcagaacctatgagaaccaatggtgtgattaaggtaatgtctaccctgcataagaaattatgtttggtgttctccagataaatagatgagccctgacatgccatcaggtcactgtgggaaaactcccttcacagcctgtttaattctccttgatagctcctccaggcacttaatcatagatcacagaaacctagcttagatgtgtgatgcttcctataacccaacactgagctaaatgctctccatggattatctcatttaatcctcacatcaaccctactaggtgggtaccaccaaacctcatgaggcatatgcaggctaagtaactgcccaagcctacactgtaagtaattgagttgggatttgaagccaggaactcacatcagaactgaactctaaatgactgtgttcttactgcctcctgaattaccctacccagttatttgcttaagacttgcctaatttatgcttcaaacagagctcattaagcaagccacaggtgtctgctaacttcccaacttctgtatgtagccgtgagaaacaatgttataaatgttgtatacgtatctcaagctctgccagcccatgagtacagggggactgtattttcatgaatagcctgcattttgatgttttgaaccttcagccacacaaaaaccagccttcatctacctctctgatgttcctccccaaggatggtggcagacatacctgttagttcatactactgcctttacctccagtctctcctggccgtggtccatctcttaggccctcatcaactaccttctgcgggctgggactgcagagtcccccagcctgcagctgctatagacacactacccttttctttgccactccttctccaagaggcagactcccacatcaattccacatcacagggttgagactaagctgttacttttaataaagcctccctgaaaaccctaagagagggatgacagcaggaaattacgtgcagcaataactaagaactgtaactagagctcacagtcccaggtccatcctgtgggctgcctctctgcctagcttcaaggcctgctgcaagtagcagtagcaagctgcttcccaccagcctgcctacatgtggacagaagccagacttctcccccctggggcaagaggcttgagccttaggattcatgaccttaaaatccaaatcacggccccaaggcacccatcagaaaagaaagctccttttccctcaaagcacttctccttgtgggtatttggagtcatgagagcatctgcttcttggtggcataattgacaataagaatattgactccttggacctttatttacatttcaccaaatattaagcaaatatttggtgaaatacttctactaagtgccatatacttattcaagagtgaacaagacagtcaggttccctgatgttacagaccgtgtgtgagtgcacgtgcgtgtgtgtgtgtgtgtgtgtctgtgtgaataaatgtggcagagtatatgaatggtgggggtacagaaaagcaaacaataagctagtaaataaataagcaagggaattactgagagcgatgaatgctataaagaaaattaaatagaataatgtaattatgcctgctcaggctattttagaatggaatatcatttgaatcaagttgacatttgagctgagtcctgaatgacaagacagagttagtcatgtgaggatatgggggcaaaatgttccagacaaaatgaacagcaaatgcaaggcctgaagccaggaatgaacttggtgtattcaaggaaagagaagaaagctagtgtgtatgaagtatttgggagaaagaaagatggcactagaagaggttggagggactggtaggagacagattgtcccaacattgtaggctgtggtaaagtttagaatttgttccaagtgcaatgaaaaattactgaaggctttaagcaaaggaatagcatgatcaaatttacgtttttaaaaatcactctggctaccctgtggaaaatggactatataaggaccaatggagtttgagaactattaaagatttcaaggtagaattgaaggtgggtcaaattagagtagcagttgtgaaatcatgcactataggtgaatcgaagatacattcagaagatagagatgacaaaatgtgttaatgagctgaatgagagacatgaaggaaagggagcgctttgagatgagttttgggtttaggctttgggctattgatgaggaaggggagactggaagatgaacaagttaggagcaagtagatagtgtgaggtacaagtctaaaactcctgagagtgttctttgctgggataaatgttcagaatccgttagcaggtggatgttatataaacccatggtgccagaggagatcagctatggagagaatgtaactcaacctgttgagagtctgggatcaagccctgaggcataaatgtgggggtcaagaggaggaaagagagccagcaaagactgataagagggaactaggctagaaggaaaagtgcatgagtggagtgtccaaaaagagaagagaaaatatgccaaaatgttgctgagagcagaagtaaaatgaaggcagagaagccaccccgagtatagaaatgaggaggtcactgtgatctcgacaaggagagtatgcagtagaatgggaaacctggttggcatggctggttgaggagagaatggcaagggaggaagtaggacatcaactcattaaagccatttagatgaaaagaaaagcagagaaatggagcaataggtggagactgtgggatgggaagttttatttaaaatcattgaaaaatactagagtacatttaaacacgaatagaaataaccagtagagggagataaactggtgacgtaggagataatgagaataacggcagtagtgaagtcttggggaaggaggaagggatgggatacagcgcttaggtggccttcagtaggtacagagatatttcattcatagcaaaaggaggaaaagcaaatcatgtaagtctagattcacatggatacagaggtcagaatatataacatggaggcattcttctctaactgcttctattttcagtgaacgatgtggttatgtcaacaatcaatcaacggtgagggagggaagagggtgttagtggttaggggaaaggaagaaatatgaaataatcacctgggaaaatgacagagcaaaagcatgagggaataaaataggattacaaattggtaatcgcctatttaaaatgtatggatagaagtttaaagtgagaccaataaaaatgtttgggtgtttttctacaaacccatttcagagcttgagtatagagggacagctaaattttacactaattagagatttgccgggtgaatatcaggggcagcaaggggtgcttggggggtcacagaggctgcaagctagttatggaacctatgctcccttcagaagatatggcagtccccttcccacatgggggtggtcttgccctgggtcctcaacaagaaaatcacaccaacatacaacattccaacataaagaggtttccaaacttctaggctgtgtaatcttagggaaaaaatggagtatgttaacaatttagtctaaattaagcttgcccaagaaccacttctgggaatgtttcaagggtgtgccttccaagggctgtaaaatgtgtcctgtcccctcttgagagtcaccatgatagggagtcatcgaaaggagtgtgtcatctctctcaggtttgttggagcaggaaaaggttggaaaatcactgttcaaaaacacctgcattcagattaacttacttcccatctttcaaaaaaaatgaaaacttgctctacatttgtacagtataataagcattcagatgtttttttccagaacaaaagactactttgcccccaaaggagcaatcagttcttccatggcctggaagagaaaacagggtgtttttttccatcccctagtcataaagatttatatacatgtatatatgtacatgtatatatatgtatggatatttgtacttatgtataaaatataggtgtctgtgtgcctaaacacacacacacacaagcatactctttcagccctggcactctgtaacaacaaatgattaagcgttgtaattccatttcccagcaaatgccgtggaaggtagaccctactttagtcagtatgagatcagaagcagttcatatccataaaacaggagactttaatactattctctactttaaaaaaatacaaataggagaaaccttgtgaataccatttaagtcaaagaatctgattcaatagcccttagttttgagataaatgtttatgtagttcccaaactgaaaaaaaagaaaagaaaaaggcaaagaaaaacattgtttgtctctctgtgggccttatgttaactgaaaaaaatcacatatccccaattaatatcagaatacttcttctaaattagggtcatcaaaataaggaacaagggggtgaaggttaaaaaggggctaagtaactacacaaagaaattgtatgctgcaagttatcccttttgcttctgtccttctgtagacatacaacatcttcagtgacgggttcctggagtactctggtttgaatcgtcagtttctcttccgccgcctggatcctttcactctctacacactgaccctggaggcctgcaccagagcaggttgtgcacactcggcgcctcagcctctgtggacagatgaagcccctccagactctcagctggctcctactgtccactctgtgaagtccaccagtgttgagctgagctggtctgagcctgttaacccaaatggaaaaataattcgctatgaagtgattcgcagatgcttcgagggaaaagcttggggaaatcagacaatccaggccgacgagaaaattgttttcacagaatataacactgaaaggaatacatttatgtataatgacacaggtttgcaaccatggacgcagtgtgaatataaaatctacacttggaattcagctgggcatacctgtagctcttggaatgtggtgaggacattgcaagcacctccagaaggtctctctccacctgtgatatcctatgtttctatgaatccccaaaaactgctgatttcctggatcccaccagaacagtctaatggtattatccagtcctataggcttcaaaggaatgaaatgctctatccttttagctttgatcctgtgactttcaattacactgatgaagagcttcttcctttttccacctatagctatgcactccaagcctgcacgagtggaggatgctccaccagcaaacccaccagcatcacaactctggaggctgctccatcagaagtcagccctccagatctttgggccgtcagtgccactcaaatgaatgtatgttggtcaccgcccacagtgcaaaatggaaagattactaaatatttagttagatatgataataaagagtcccttgctggccagggcctgtgcctgctggtttcccacctgcagccttactctcagtataacttctcccttgtagcctgcacgaatggaggttgcacagctagtgtgtcaaaatctgcctggacaatggaggccctgccagagaacatggactctccaacattgcaagtcacaggctcagaatcaatagaaatcacctggaaacctccaagaaacccaaatggccagatcagaagttatgaacttaggagggatggaaccattgtatatacaggcttggaaacacgctatcgtgattttactctcaccccaggtgtggagtatagctacacagtaactgccagcaacagccaagggggtattttgagtcctcttgtcaaagatcgaaccagcccctcagcaccctcagggatggaacctccaaaattgcaggccaggggtcctcaggagatcttagtgaactgggaccctccagtgagaacaaatggtgatatcatcaattataccctcttcatccgtgaactatttgaaagagaaactaaaatcatacacataaacacaactcataattcttttggtatgcagtcatatatagtaaaccagctgaagccatttcacaggtaggtagccatgtctcggttttctgagagtaagccactgctgacctttctattgcctgagcccttggtcagttctaatgaagactctaaaaatgggatgcaaggtgtccccaacctccatccacctaaacgtgcatagtagacaaagcacatcctcacccaagcaaagcctgcttgcataacctccagagagcagaattctttcaggtgatgttttgagagtcagtgtttcagaaaggtttgcaatgcatcctggtatctgaaataagtaggacagagatgaggctagtccccctggaaatacgcaggcccctggacagttctgacagccccgatagggtcatctggccagactgtgaagaaaatgatgtattattttaaggttaaaaagtgccaatcaatgagcgcaattaccagccagagttagactaaaacaaaatttgtttcgtgaagagccttcttatcaaatccagcacttcttccaggaataataaggcttctctgactctactttcttatggtttctcaggacagtgccactttgctagctcatgttttcctagcggtcccatctgggctctgtgacatgcatggaagtgcgttgttctccacacaaaagaatcttgcccattgtttaaataattgtttggcagttttccccatcacattttaagtaacttacatccccagagagaagggtaataagagacattttatgcttaaaatttagtaaaatgaacagaatcacttaaaaaaattaaaggctgaaagagtgttgatttccaactacctcaggtaaaattcagctattattgtaatctagtgatgtgtagattagatcctcctataattacctctgatatatagtgctgttgaaatgaaacattcgtggttttatgcatctactcatgacaattatttagggtctattaaatattaaacagtaattaaaacttcctcaggtatcctctgcagctaatccacatgctatgtgagttggcttttatattaccttacactgattcagggcattaaaaaggtccactgtagctgcagagctgtatattctagactggcttcctctttacctgactgtacctccaactttcaaaaaccatatcaatttgctcccttttgaaactcttattcaaaaagtattctagaggtgaaagagtttgtccaggcatgaaaggaatgctttttccaggctggaaagaaaagtttaatttatctgataaattgcaaggatatttaagaatgtgagagaaatctcttcattatccactctaactgaatctgtaagtggcattgacataaaacagagtatcacttctatatgaagttggagttcatgcgtggttttttgtttttgtttttagtggattaatgttcactgaatattgcaaatgtgtgtgtcctcctttcagcacccccagctggtcagtaagaagaaatagtctgggaaagtcctaagtagcagaaggaatccagcccaaaatttaaaaactaccacggataacccagaaaatgaataatctttatgtgggaaatcaaaattgacttcacagaattgcttagaagtcagatctaccatacacagctatggatttgatcaccaataaactggtagccctgtcatggtggagatcggcatgagaggagaaccaggggaggaggagaagaaagtgggaataaaataagtcacaaagggaaaaaggtgtaattaagaaagcaaaaaggtggaagagacagaacatgtacaagaacagaaagcagtgattcaaagagcaaagaggggaggtagaaaatagaagaggaaaaggctagaactaaaaggaataaaggtagaaagaagatagctgggtgcctgcgggaaaattgaaggtgtcataaaatcaatggtggttgggaatagagaaaaaagtgctcatttacagccataggcactaaatactcacaaaaactcattttgttggaaaggagaagtccctgctatgtaaatagaccttttcaagtagcagagaccagctatgaggcaaaacataattgattagttgaatttaactggatggtgataaggtgtcttcatgattgataatctggtgtgtagttgggttaactttggccccgcaaggtctttgtatcatgtaagggaggctgttttaagctgttaggtatcaggtgaggggatttattaccactgagaccgtaattccatgatgttccttcatgacctggaaacattcctgggggatcattccatgatgttccttcatgacctggaaacattcctgagggatcatttagctctagctgcaaaggtaggagtccaggactgctgagaactgcttcatactttctaaggtctgcattcttcattgctatgttaagtaattctgaagagtaccagaattttcatgccggaaagaatcttgagagttatttattccatacatccttgtttaggggaagaattgcactcacccctttcgaacagatcaggaactttagtttagaaagccagggggattttgattgttcaaaaatttccatggaaatataatttttttttgagacagagtcttgctctgtcacccaggcgggagtgcagtggcgcaatctcggctcactgcaagctctgcctcccaggttcaagccattctcaactttgttattcttaagaattagctgtgaataagaatacatgtaagcttgtcttttttttttaaggcctggtgttttaaagattcttcccatgaaaatctattttgctgaaaatcactaatttctgccttatgtcctgaaggtatgaaatacgaattcaagcgtgcaccaccctgggatgtgcatcaagtgactggacattcatacagacccctgagattgcacctttgatgcaaccccctccacatctggaggtacaaatggctccaggaggattccagccaactgtttctcttttgtggacaggaccgctgcagccaaatggaaaagttttgtattacgaattatacagaagacaaatagcaactcagcctagaaaatccaatccagtcctaatctataacggaagctcaacatcttttatagattccgaactattgcctttcacagagtatgagtatcaggtaagaaatgtgtattataaacaattcgagctgattgtttgcacccgtcagcacctgcctgtaaaaatggtgcacaatttgaaaaggcacttaaagaaatgtaggacttaaggagaataataatattccttaaaaatttttaagtggtaaatgaggaaaaaccatgttcattgcctttttcattttcttggtttttgagccatattatatacgttgtttttcttaagtagattccaggtgaatttgcatttcttattagtaaagtggtttctgccattaagattccctctgtcagcgttgccttggtaggagacactccttatttaaagatcactttgaaaataactcattactcgtaccaaaataaaatcaaatagcaaacatctctagcctcggtgctcaagaaagatacagaatgttgaaaaaagtctagaggaatacaactcacctgcccatggcgatgagttaagttttctctgaggatggcctaaaaaaataagactgcattcttaaaaagccaagaattaagaataatattcagaaaatatggtgaattctgtggaggacttctgttaggtttgttttgttttgccatcagagtccatttgcattcttcttgtgataacaacctcatttcctgtgggagaatgtgcttcccccaccctttgctcaggcgtggtgggagtgtcaatcaatgtgtcaggctgtcttctagccaagtggtgggcacatgagccgctcagcccctcagatttgcctggggcttgatcttcagcagagtgactcagaattttaaaaggtggaggtgagaagtcgtgataaaatatccctaacctcaatctaaaagtttttcttttccctgctatttccaagcatggttcttcaaccgttcttttaattccataaactcacagtaaattctcatttgcttaagtcagaatcagtgcctcttgcttgcagtcaaagaaagcttactgactgatgtaagcacttaagtgccaggaacaatgccaacagaaattttctaaaagaggaaactgagccttaaaaagcttattataacatgaaatactaaaaataataagtcaccaaaaagatagtgaccaaatcaatgagtacagtgaatacagggaacattttaagcatgaaaagaatattttaggacaataatgtatgggacaaattaccgaattaataagatttaaaaatataaataaattctcgaatggtttggaaaaatacacagatataaatccataatcccttgtttgcaattccaagtctaaaaatctcttaaaagtattttcttgctttaccacaagtcatttggcaacaaaacccaatctaaacagacttgagactatttacagtatttatttatcccatttaatatgaatatttatatgttttgctacaaaaatattgctttattataagatggctaatcagatcatggtatggatattacaaaatatacagtatatacattttatcctatttcaaaatctaaaaacaaaattattttaaaacacatcaggcccccaagggtttaggataagaattgtggtttatgtcataaaggaacaaaatacttaccgatgccaccatcggaaacgtaacactgttagaaacagccagaacctacgtgcctgcccttttgttcttttctcattacctttattgagaagtgtcacgttatcaagctgtcagttatctagtctcccttacaaataaaaatggtaccttcgtgagagagctggatgaaatcagcataaaatcttcagccgctaattaaacgcaacttaatgacccatatataagaaacacaaactttctctggtattgtgttgtgtcattgggttaaattctggtcacatgatctgtggaagtctcattccagtttttgtttgtttgtttgtttctttgttcgagacagagtctcgctctgtcacccaggctggagtgcagtggtgagatctcgagatctcaactcactgcaacctctgtctgccaggttcaaacgattctcctgccttagcctccagtgtagctgagattacaggcatgcaccaccacaccaggctaatgtttttttgtatttttagtagagacagggttttgccatattggccaggctgatgttgaacccctgacctcaagtgatcagcctgccttgacctcccaaaatgctgggattacaggcatgagccaccatgccaggccccatcccagttttctatggaatggaaagctccaagcatgtgccttgtctctagtcagatttttcatcaggcactaaggatgactaagaacaaagggacccacatttcagaggagaggcaagttaagaaccttaggctgtgtggtttcttttgtaactgttactatcggctctgtgttacactcctcctccatactcatctcactcaaatgaaagtatttaatttggtttttgatctccaatttttatttattagctaatcccacgtagttacaacataaggatagaaaacaaagaaaatcaaaatctagcttagcccaaaggcccagttcttatggaaaataatattttgaaaagcatagattaaatgctgaaataaatgatcagaaaatattagtttcatttagcctgtgtaaatattgagtctatgtggaccctgagtaatcttacagaagtcatttaggaagttatatactaaaacaatttatttttctttaacaaaagagcatttttgtatttgtgatgaatttgcattgctctcaaaaccacttgagggttacttcatctgcaagtggcctttgaaaataccttcattgtcctatataaatctgctcacccagcaactgacagtgatttcacccttctgcagaggagtgtgtttttgaggtaattgtagattgtagggaataaaaacaaagacctgagaaacttcctagcagtggggaaggattaatcagaagatcgtgaggatgtatagttggggaggttgccacccacatggtgtgccttgcaagtatcagctggggctccccaccaccttcctacactacattacatcattgtactcatttctggttttgagttaaatcattgaaggcagttgttaaaatttagttatgtgaaaagaacaagacagttttcactagtctaaatcaactcattccatcagttggccagtgatagaagagggtatcgcatggataagttcttttgtttttctttcttcttttttttttccttcttctttgtttttttccttcttcttctttttctgagacacagtctcgctctgtcacccaggctggagtgcaatggcacgatcttggctcactgtaacctccgcctcccgggtttaagcaattctctgcctcagcctcctggtagctgggattacaggcgcccgccaccatgcgtggcgaattttttttgtatttttagtagagacggggtttcatcatcttggccaggctagtcttgaactcctaacttcgtgatccacccacctcggcctcctaaagtgatggatgagttctaacgggcaggagggtcaggaaatatctggagaaatggatacttatagagagggaggagctactcactgcagaaaaccaaagagggaaattaaatgagcagcaaatgtcactcacctcaccacaattcatataaccagcttgataactagctcctttgaaggtgagcaaaatccatgtgatatcacaagcaccttctaagtgttcactaatacttcaatatggaatgccctaaaggtagcatccccactgtttacagtacaagtggaggacctaagagcttgttcaaagggcagactcctgggtggaatgggaagggaccccagcaaccagtattttttttctttttttgagatggcatgtcactctgtggccatgctggagtgcaatggcgcaatcttggctcactgcaacctccaactccccggttcagtcaattctcctgcctcaccctcccaagtagctgggattacaggcacacaccaccacgcccagctagttttttgtatttttagtagagatggggtttcaccatgttggccaggatggtctcaatctcctgacctcatgatccacccgcctcagcctcccaaagtgctgggattacaggcgtgagccaccgcgcctggcctagcaacctgtacttttaacaagcagcctggatagtccacaacccacttttttttggaaatactgcctcagagggtgagacattgctgctatgctacttaagccttattttcaagcggtgattttctgaatcagtggttctcagctttgtgcattagaatcacctggggaaatttcacaacattctgggtgctgatacccagtccccattcccctgtagttctgattctgggatgggttctggaatccctgcgattcaaaaggttcccaggtgattctcatgtgcagccagagttgagaatcactagcctaaactgtcataaacagcccaaataagtgaagccagctccccacaaatgcctaatttacatgatgatcattgataatagcctattgacgttggtctatcctggctttcctaaagaagggtcctattgttttgatgtgaaactagaaaggagaacagaatatattatctacaaagtccatgtctcagctactcatataatttattttaatcttcctcatggattttatttggattttgttattgttgttttattttcttttgtttcttacttgggaggtccggtctttggtggtaagagtaaagttcaccatcatttaaaacaggggatttttctagtttgagtcatttcagcatagcttccagaattctgggattctgaaggataacactctggaggattagctttaataaagccagtgagatctaaaatatgaatcaaaaaattaggaatattactttttcttgttttccacaagaatgggttggtggctttacagagtgcactgcagggtcccattagaaagcaaacattctctgtgaatttcaaatgcaacttagtttaccaaaatctaattctcaaacaaccctgtgaatgtatgttccatgcataaatgcgatgcatctgtactaaataaaattcttccattgcacagacctcttccttaaacagagatcacagtcttgcttgtgctacagaatatttacaaatccaagaagatttttttaaagacaataatcatttctatcttcaaccctttcaaaattgggctattctaatacatgcagtgtgaacctccaaattctatgtggagcagttcttaactgtttagcagcaaattaagacaatatttttcccacaggctttgagagggacctgggtgtgagtctactctgttaagacattttggtttttacctttggggagtgagctgaggctaatgaatagctctcagtaattgtgcattcatattcatactcttgcttaaggcaaagactcaccacggatttgatagggcccgccaccaccccccctttcactgattcatgctgtcagtgacttaattagttttcctgaaactatctcactttgacagatttttgcggtaagcacccacgcacactcagggtctctgaagcattctggtgcctcatgactgggtgactgagaagcagtaggtcagtcttagaggaaactctgtgactcatggcatggggtctgaacttagggctagtgctgcaggagcccatgcagaatggcagtctgctgctttctaacagaccaacactgcccccaaacaagaggatggaaagaagggctgtggaggagacacagaaggggatcctcactgttgctgccagtggcagctgcctgaagactgccagaggtactgtggaggccttccctgcaccagcccccaccataggctaccaaatcgttggcgatgagttagaagtgggagggagaaaggccaacatcttctactccttctctcactacttctggatatttgagcacattaacctctttgggcctttcctcataatataaattaggcctgctatgatggaatatcatagactgggtggctttaaataacaaatatttatttcccacaattctagaggcgggaaagtacaaggtcaaggcacctgcagattcagtgtctggtgagggccaccttctggcttacagataatggtcttctccttatatccacatataccaggtagaagaacactagtccccttcatgagggctccaccctatgcaacctaataacctcccaaaggcctccataccatcatattcaagattagccttcaacatatgtatttgaaggggacaaaaacagtcagttcatagcactcatctataaaaggaagcaccctccagctctgtattctatgggcagagtagtggtaagctacaggtatataatttttagaaagtctaatcaaactttatcttctcttgattggtttttgtaatctacagtttgtaaaaccctacaaaataaattctcacccaaagcaacagaattttctaatggtatttagctttaagttgtgttgatgcaagtgaatgtatgaaatcagcttcagataataaatggatatatggttattcatcaccaagatggacacatggaaatataattagttgtgtctctcattgaaacctaacatatttattcactaatatattttttaaagtatagctatattataacatatgaatgtaaataaataataaacttatttagttagctacaaataagtctcatttatgttcctgagaaaacccacactatcaaaaagttgtcatgactatttcactacaagtaacagaaagccaatgtaaactaagttaaacagaagggaattgtttctgctctcgcatctgggaagggcattgaaggaatcccttgaaaccaaagaaaagatatgaacaccaggtcctggaaacctgggatgcaggactcggatgatgtaggattcattcattctgtccctccttgccccatctcagcttgtctctgtttggcttcattctgcacactttcaccaggcatctgaggaaatcactcccagattcaagccctttctgtgcatcagttttcttgtctttaaaatgtgaatagatatagcattggactcataggcttgctctgaggttaaatgagttaatatgtgaatgtgcttggaacagcacctcatacatagaaaccacttcgcccatataacaataatgattattattattacccatccaccttagagtggaaagaggactataagtcaaccaatacaggactctgactgatccttttgcactacctgccttcctgtgaaccaagagaacagaggactatgattgagcaggtgtggtcgcagggcccacctcctacaggcagggctgcatgaggtatgcgggaaatgcttccagccagaagcaagaactgccctagcacgctacacacaccaaccacgggaacaagtactccacacctgtgagatattgacaatccttgtgctctttcacattggatgctcacacccttcctgttttccaaatgaagaagctgagttaagatcacatagcttgtgcaagaaagatacttaatttctgataacttcacctttctcatttaaaaaaatgggtgtgttatgagaactaagaaatctgtgtgtctagtaggatgcctgctacttagtaggtccatgcccccatccgatccccccaggatctcactagttaaaagaaggagaaactttcattcaagactgtaaaaaagccaggttaagacatttcttttgtctatatcaacaagtcattgataaaatgttagagtgtaaaaatctcaatcaggagtacagttgcctctaaaggtgtgatactccttccgctaggaagttcaaccctcctcatccttgccatttctcttctcagaaaaagagtaatttacccacatacccatgactaaaattccaaactctgatagtctgactctacttttatgcaattagctacttgctttgtattgcctgttttctattgctgtcacccttaccccatctcttttctatatcacatttagagaaaacatattgaacacattttctgtttagttttggacttgcatttaattaggtattaatctcactaatgtatttccgaccagcatggaggtttttgtctggttaatttctcccacaagaactaagctccccacacccaccccaactcccacagctcaaggttttaaatgatttattgatattgtctgactcaggcagtgtatttattctaaaactttagggcctgagtgcacaggttagactgaaggccactgggacatttccatgtatagaaaactaaagttcgccactaggcccagggcctgatcattttttgcatcgagccttttgttcccacgggagatcatttccacctgtcagtgtgagcacattcaggagcatgctctaattctttttgttcttgttccatctctcatggcaacccttaggactttattctgaagcttctgttgttggcaatcttcatggcgcctttgggacaagttatccatgtgaagatgggttggttctcaccctcttgcagatgcaactcagatttatatttcacttaaggtgatgttgatcttcctgtctctgtgttggaagtttgtttgctgaaaataaaatgttaaacacaacagatgctcttcaactgaatgtagataatatgccattccagcctgccctcatggctcttcagatggccatgaaaacaaaggctcccaaagtcacctaaaacttaggtcctgtaaaaacatctaggaaagggtaagatgtgttttacttattttcctccatcctgtaaattgagtatttaataaactgtccttattaagcacctacaatgttcaaagtgtatacctagttactaggattgaggcaggaggctaaaatccatgcactctccccttcagggacttaaattatagttgataagtcaaataaagatgcccatgaataatgtatccataaaaatatggctaggaacgttgatgtttgcaggatctgagtgatggcaaaacagacccagggaggaagaagcagcttctttatcttcagggacagcacgatttccacaccaaactctaaaggccactcttattctactctctggccagatggttttgtgcaggacaggtggcaccttgatattaaagaggtacttgactaaaatcattccacagagacatgaaggggcaccatttctctgttccttcagtcttacaaaaagaaatccctttctaaatctccatccttatgtttagaagcctctcttagcccacctactgttattggtacccatgtaatggttcaaaatattctccactgtatcaatcgggatctcagcaggaaacatatggcacattcaaagggtatttgaagaaaatttaatgaagaggctatttatggaggtgtgggtagaattaagagaatcaataagggatgttgaagtacccagggagtaggaagagccagaagctgttaccttctaggcctgcagggacaatggaagaaagtgggtcattgagaggaaattcagccttgtcaacatgcagtgccaaagagaggagcaggagaaacaaagaacctgaactctctcttccctttgatcaaaacctaatggaaaggagccagaggagaaaagattccaggtgaggcagtctgatgaagtcagcattccagagtacagaccaagccagagaagggcagaggatggatctggggaaaaaccagctcgtcccccacactcagattgatgctgcttctcaaccagtatataataatgccttcaccagtagaatcctttctgggctagaggatcacctggccagctttggcttgtcaatctatgattattgataaaccactaagtaaatctgaagacttaaggaggattgtacttaagtacttgaaccaacagcttattacctttaaattgtaaataaacatctcaggatatatgaagcaatctaatctgcaggtggaaacaaaaatgttaacacattcaaataagtcagatgccttaaatggtaatttgtaagaacatagttgagacttcttcttgttaattgatttatctgttgatggagctgatcattactaatatgcctataagcatctagaaaactgtacggttctctctttgattcctataggcatatttctaatggaaaccagtaataaaattcttttctctaaagaatccattgaattgctctaattttttcttttgttcatgtttgaggactttttgagaaattttaactaattataaaacaaagtagagaagccatccaattaacaaatttcattgtagagcaatatttttgaaaagccaggcttttatttactctaaccctcaaagctctacagtacagaagtacctggaagaaagatacacagggaggtgtgggctaaattccaaatgctgtggggagttttccaatcttattaatgtgtaacaactaactggaatccaggagtgagttgcacaattgctatctagccccactagatcccccaaactgttaagtcattctctcctgtcttttcacacaaataatgtgatagtaatcactattatttatttagggtttgctgtgtgctaagggctgtgttaagaactgcatgtatattaactaatttaatctcaaacaaccatttgaaataggtgttattactgacactattttacaggtgagaaacatgaagcattgaaaaattagataccatgcccaaggatatagagttgataagttgaaggactcaaattcgaaccttaagattcagtttcaaagactggtttcttaaattctaccccaacagttacctccaaattgcatttgtatgcagctttgggactttcaaaaatcaatgaaatatttataaatgtattcatcccctaccccattcctcagaaatttctagaaacaatattgcatgtaaatcttaaaatagtcctgtgggatagatgttgttatttcttagcatagtcaagaacctgaatgatttagcaagttacctagtcaaaaagcaacagagtcagaactcaagtcctgactttctgaccccaagttcaaggtggctctgctgaactgcagcttcttcaagtcacctctatcaggagcacaaattcctgaccctgtgaagacagaccgattagggttgcagtctaggctacatgaattaccaattctggatcctcagctattaatttaaactcactaaacctcagttttcttatctgtaaaattgagattaaaaaaacaaacaacaacaaaaaaaacttaccccaggaaagttgctgtgaactttaaataagttgactttaaggctagggtattgtcacttacaaaaaaaagtaaaatttaatatataaatacatagaaggtgttcagtatccagcattcctgcaaaatgaaaatcaaataaagtcactctcctactgcaaaccctacttcccccattccataagatgcaaactcctctctagttccatgaggactttcgtggtctcatttttgtccaattctgtcctcatcccattgctttccggcccttactcactaaggtcagccacactggccttcttgaggatctagccttaaggcctttgcacatgcttttcttttccatagaatgctcttccctcagatcttcatctggtactttctgccaattgtttcccagcttgatggtcatctgttgagagaacctcctggataagccaaccattttctgctctatcaccttatgtatatcaccctacaatctcatcatttcctttctagcatatatcctaacctgtttattttatttgtgtttttattgattgcctctcctcaccaggatgttaatgccagccttgttcactgttgtatccccagctcatagaacagcatctggcatatagaaatggctcagtcaatatgtgttgaattcatggatgataaatggtcttacctaatttactatccttcacggagatgttaatcacaattggtgattgtgatcttagcttcttctagcaacttattgtggataaagtatatattttaatgctatatccattagggtatagttattattgcagagaacataatggaatttcaatgcatttacacatgtttgaacaggatgaaatatatgagtagtacttgcttctgtgtaatatgcaatattgctgaaagcatgataagtggcacgagagatggatgtcacgttgtttgtgatagtttcccctgtctcacttttaggctaccctccacagaaaaagccagtccacgcagggctctatgaaaagcccaggacagcaacccacccatgtggaaggtgtgtacaggccttcttttaatggccttatgtaggaagatgtaaagagtttgggcttttatgtcacatatctgtattggaaagccagccttaccacttaccaagttgcataaatttctgtgttcctcagttttctcatgtgtaaagtggggataataataccaaccatataggattgtcgagaggaaaaatgcaaaattagtacatagaatacacttacaaaagtgtaagtgctcaataaaccccaaaactacttttacatatcctccatgagagtcggatgggggtgggttcctgtttcctcttagggagagcagatataagaaaaaaaaaaaagtatgtgataactccaaattttgattatttagttttattgttaaaagtgaatcagggttgggaggccaaggcgggcggatcacgaggtcaggagatcgagaccatcctggctaagatggtgaaacaccgtctctactaaaaatacaaaaaaattagccgggcggggtggcgtgcgcctgtagtcccaggctactcgggaggctgaggcaggagaatagtgtgaacctgggaggcggagcttgcagtcagccgagatcacgccactgcactccagcctgggcaacagagagagagagactctgtctcaaaaaaaaaaaaaaaaaaaatcagggcaaatttcagtatttcacagtgttaggtcagtttttccttcttcaggtattagaggagaaccatattcacaagtattaaatggctccaaagagcaaggcggtatgagaagcagtagcgacaagacacccaattctagcatgggaaatgtcttgttatttttccagtagcttcacgtctctgaacttcaaaagtgctcatggaaagcaagacaatgtcctgctgtaccctcttcccctgggtcccagaattcaattaaaatcacgttctatcttgcctaatccaaagtgttttagatgaagggaacctggaaaacgggactatatctgtaaaagtgtgactgtattgtatccagcaaggttctatgcagatagagatgctggaaaacatccatttgatggtgaaagaaaatcagatagatagacagttaaataaatagctcctagagcttttcagcacattattccttcataactggagcctgcagggctactcatgaaataaaacaatcttgtaatcatgtaatttcaaattcattgcattgtcttttttgccaacattctttaaccgcgattccagcaaagaagatttcagcatattgctattcaaacatattcaaaacctatgacaagctaccctttaagaaggcattagcgtgagtgccatgggaaaatgtactccaaggttgtagatgaattgatatgatctccttgattgtatctttttatttatgaggcataatttctgagcactggaaagcaaactgcaatgagtgatgactaacaacaaccaaagtcataaatcagcagcagtgaaagaagtagtgattttgatcgaatctattgaattagctgttggccttagccaatacaggtattggaaagacctttttaatatctatttgtccccctcatgggaatgtgataacaatctcattacatgcccctaggaaacaaataatttaattgtttgcccgttaacatacaacctgtttacttattaattactggcatagctgttcatgctagattttttgtttatttctgatgtgaattgttacaaaattatgttcacattccttagtttttataaacaattatgtctccttagagcttcttgatataaatttgtcctcagaattgttgaaatgctttttttaatcaaatattgtcattatcccacaaggaagtatgttacagagtttcacagaagttgcagagagctcagatattcttccctctcttaatctctgacagttaacacttttactaatacaactcttgtaataagcagcctggataaagaacaaaaatctcaaattgctccaagcgtaaagacagtcatcatcacttacattaggagttaacagattagagatcttttgtaaaagattaatcggctgaatttggttactcctgtattacaattttatgaggagaataatagcaaatgtaagaccaaatagacatcagcttggtgctgacccatatacaaaccatccataaaccatatattatgaagtatgttcccttgatttgaacaagacttgtagcattgccttggccaaaagaatcataaaatattttcacaatttaggggtttttcttatgataccataaaggaaaaatgcatcaggaacccccttgaaatgtacattaataacttagctttgctgtaagacaatacttggaaaacatcagtcctaaggaaggttatttcagaaagatatgagacattgagcgaggcaaagcattaaggtgaaaactactttgtttagccaatacaggcattagaaagacctttttaatatctatttgtcccccttatgggaatgtgataacaatcttaacaagttaagtgtggaaattgtgctaaaaaataactagcacaggccgggcgcggtggcttacgcctataatcccagcactttgtgaggcggaggtgggcagatcactaggtcaggagtttgagaccagcctggacaacatggtgaaaccccatctctactaaactacaaaaaattagccaggtgtggtggcaggcacctgtagtcccagctactcaggaggctaaggcaggggaatcacttgaacccaggaggtggagatcgcagtgagtcgagatcgcgccactccattccagcgttggtgaaagagcgagactctgtctcaaagaaaaaaaaaaaaaaaaaaaaaaaagaataactagcacagtaacagaagcatccaaagggtcaccattcttggagatttctgatacatttccccttctcccatcctgtgcagactgatggtcccttctctttcccattcacaaaaattattacaatgcttctgttcacaaatgtttgcttttctcctagaataaaattaggaggagaaatgttgggttgagagaaattgggagcatttagaataatgttactctgcactgagagaaaaatagactcagcaatttctagaaatatcaaggtttcaagaaattactccttaagtgaaaattaggaggcaagaagtggttctacaaagtcagtaaactctagttctgtttggaactgtgaaaaaacacagtaattaactctatgatgattattgaattgtgacatattccaagatacatttattgtgtttatttgaatgactaaagttaatgtgaagtataactctaaagagacataacaaatagaaattgaaaatgtacagtgcctatattctgtacctggctctataaagaataggcctttgtatttttcaaataatattgggtgtaaaaagcgcttggaaatatgttgaaagggcagagtccaaggtcttctcaccagaaattctgatacaggtacccaaaatcattttgatgaccatggctaaggaatatattgtgacaaagacttctcttaaaagaagatttctaagaggcaattttcaagagagaacaaatgattaaattcattgttttcacagcaatgtgattatggcagcttagtggcagatgttgacactccatgtaattaaaaatttttaaggcaaaatacaataattagtcctttggggtaggaaagagtaaataaaagaacaatttcatttttttaatgaacaacaagcataaatatggtaatagtctctagttagatttaaaaatatattacattgaaaacagaaattccattgaaaactgacatattaatctatcattttgctagttaattacagaatttgtggctaaacaattttagtttttatgcttattaaaagtagttaatctatgttttctatgacattttacattgtaactttcttcatggttacaacagaaaccttagagaaataaatcaacaagtcagtcagtcctaacttttcattattaacgactagggaagtttctgactctacaatcataactgtgtgtgcacccactcattcacatgtgaaagtgttcaccaaacccaaataataatgtatttcagcagcaactttaatcatctttaatcttttattataaaagaataaatatgttcagtctatgagaacacatggacacagggaggggaacatcagacacagggaggggaacatcacacaccagggcctgtaagagggtggaggctgggggagggatagcattaggagacatacctaatgtaaatgatgagttcatgggtgcagcaaaccaacatggcacatgtatacctatgtaacaaacctgcacgttgttcacgtgtacactagaacttaaagtacaataataaaaaaatatatatatgttcagtctaaacactgtaggaacaaaaatatcctgaataaatcaaagatgaagaacatcttggcttttttttctcttggccatagaatttataagccttacttgcttttcttccccaataataactcttccatttttctaggagaagcccacacactaaagaaagagaaaatacacaactgtttgttcacaagatattttatttattgatttttatatgggttcattgcaactaaaagatcgggacatattgctaaaaagttttctatgtgggatctctgctgcttctttctctaccctataaagacagaatcgaatcttggggcattgtttctcagtgggaatcataagcataacctgttagtatttttaccctgaaccctgaactacacttcaatacttttatctcttgcttagccgggcatagacaaaaatccacagtgatattttagacaaagaacgtttttacctcagcagagacagagacaaagacagagagacagaaggagacagaaaaaatattattcacaggttcttttttccttttctcctagtggtttgatataacagagacactgcctcatcatacaagttttgtgaaattcataatgcttcattatctcagtcagctttctcttcattctgttttcattttcacagtagctcatgtaaataggttgatcctgctttgcataagcatgttgatttatatgaatgctattttgatctcaaattgattgaatactaaaaagaaagtctaggaaaaagagtaatgtattatgaaggactcctgccaaagacaaaatagcctgcatacattccctattagtgatggggaattttgaattgcctggttttcaaagagaatatttccaaggaaatatagcaaaacactataatactgaggcccaagtgtttttaaaatccagggattaaatcacattttggaactagaactccacctagtagaagttcacgtaacacaggaaggctgagatttagtacaatctacgacactaccattaaaaagccttaatagtatttatgattctatatctacattgaaaatgaaagaaaagttaatgttcataagccagagccagaactgtgctgagcacttgctatgaattatgcttatttcatctcattttctttcaacaccctatgcctgcactacttccatctcctattggtgcacagtaattaattggcaagttgttgaatttttcttttattatacctagttgcactttcttcctcattttcctccccatccattgtagcctgaatttaaattctgcctgcgctcaaatcaccaaccaaagttctgctcttggcaaaaaacgtcatatcaatatttgcaccttactttgcattcctttgtcaagaatattgttttaaatcttgtcattcattgtgtaataataggtgtcccccccaccacttcccagaaagatatttgcagtaaaagaggttgttctggggcacagtgaggagacaggaaccctcctcatcagccctgaagtctgacttcttcatgaataacctccacctcccctccctagtgtaagtctgacctcacctatttctgaggggactctgagagcagctgcagttgtattctgatggatggactctaacttccatgaaatctggctctcccattgctagctccttacttccctgtgcttaccaaaacaaacctccctcacctaagacaacttgtacatgtctatccatccttgcaagctaagacaccttaacctaatctagaattgcaggtattcgtctatggacaagtcgtttaattttcatgattctgactattttatttatgcatatggatggcatacagaatcaaaaaccctgctcattgaaacaggcactggagagcagaattcttgtttcagcacttgtaacttttgtcaccttgaacaagatagtgaaattttctgaggctcaatttcctcacctttaaaaggggactagtaatacattctcggctcaccttacaaggtttccattggaaggactaaataagctgacataagttaaagtgctttgtgaaatgtagagtttatacaaatgtgagtgattattatgcaaatgatgagaggatgtatccgagctctaaaaagagcaggtgtatctatgtaagtaggttagttgtctcttttaaaaaatgaggctcctggcaatcctatcagcaaggggctggagatttgcatttgacagcaacctgaaaacaattcaacatcagaaaatttactttcacaaaggaatccggaaaaaaagaaaagtatgaaaaccactgataggagttgacctaactactaaaaatctgtctaatgtttcttctcttgaagatattattgatgcaaaagcaaagtaaacaaaaatgaaactaaactctcactgcaaaatattctcataggttttttctttttttcccccacaaatatctcctattttgaacattctgcatgctttttttttttttcaatactgcatgcctggaatgtgtgtactgtagaatcaaacaagtttttcagatttgtctttaaaagctcgggggcaaatttttagaaaatatataatgtagaagaaacacaatgagaaaaaaatttcctgaagttaggctttcacatgaaagcttactaaggaatactactactcctaaacacgcagacagtcttcttgtattgccatttagatctatcattctgattgatcactgtgtagttggctattattgggcctaatttaaccctatacactcacacatccatctactctgtctattgtacctgacattctacaaattacttactcatgcaaatgacgacctaaggcaaccttttaggatattcgtgtttaattatacaaatggttcttgataaataagattatacatcgttccatatgtttattccctccttgatgaaaggaaatttaattttcatgcagatttggtggggacaatgtttaagaattgctgagttttttgtagtctgcagatccatccagtctgcagaagctgacaaaatcactccacttcccacacagagatgagcagttttttcattaggcttaaatcaacgtgctgcattctgaaatcctaaacggccccctttgtgttcacatggtcaaaggcaaaaggcaaaaaataaaaataaaaaaggaacagcctgctctccttgctctcctgtgtgattacaaggttgcaagatcaaagtttatctcttcctgttgtgtttagttgcttttggttgccaatttcgttttttttcctttcttttttttttttttttcccagccttagggtatcttgcttttgacagtcttgttgatttctctttggaggtctgggcagtgaattctgcaggaaaagcccccagtagctggacatggtgcagaaccgggccagccccaccagaaggtctcagagcccccacgttccatgtgatctcttctacccaagcagtggtcaacatcagtgcccctgggaagcccaacgggatcgtcagtctctacaggctgttctccagcagcgcccatggggctgagacagtggtgagcagcagagctaaaaatccaggactggttgacttttaaaaatcattactatgaaacctttgtttttatgtttttgtttttccctccatctttcttatccttctgttctcagttgctctacggtgaacttagtagcacaaatatccctcagagaagaaaaagtgaaccctgaggaaacatacagaaagtatgtaaactcttagggagagggatgctaaaggtggtattaaagactccacaaacgtaagaaactaagactttaaaggcaatcacactaatttaatttaatttaatttaattagaaaacagatcaaccacttagagtggtggcacatagtaagaagttggcaaatggtaattattggtggtgtaaatgttagtatgaaaacaaaatagagcaaagaatatccttggaatctctattttgacatgcacaaatctctaataatacatggaaaactctcattcctctggtgatttcaagaaagttctaaccctttagaagagagagcagagcagctccatcagcatagccctagctccactgtttgttcgttaacacgtttgaggcacactgggagacaggagagattgctcagggaaatcatctttcacattgtgcgttagccaagccacttcccggaagcgatgctaagaatcaactagaccagttcctgcattatttaaatgaagataccagcagccagcacgatgaagactcttgtctctgtggtatagcttgtgtcactctcaagtttctcatgaataagtggagattataatactttgttcacacaaacattgtatagagattgtgcagatcctggtattacactatgcattatttaggccaatttagggaacaatttgggcaagtgtggagaattcctctgagaccagagtgtcaggtattgaaacacaatttcaacagataacttacatacagggaggcttggattgaatgttaaaggaatattagcatattttctatagggcttcgtactcaataaatatagatgatgtaaatacaatcaacccttgattatccatgcttataaaatgataataaactaaaataatttatatttggagggcattgtatgcattttttaacagctcttcttaatcatatgttctttatgtcaacatgaacattaatttcagtttctgaactcttgttccgaagagtacttattaaaaccacaatgaggttaaaaatttgctcaaaataaaccaaaactttataatcctacaaagatgattgagagaagactatgatattttgtaaaaaccaacaccctcagaggaagagatagactttcaagccctccaatacttatacctgattttaatgtagatctgaaaagattttttgactgagaaattgcatgcaagtaaccatggcagaatatggaccttggtgaatgctgactagacatataattggaaggcagattttgttttttgaaaagacatcactctgagggtcatagactttgatcaacactttgtgtgttccgtgccattttctaatacctttctaaggtaatagataatcgataatattatgccttgtgatttccatcctgctacctcaaacgtctatttaacggttacattatcagatttttcacctatttgtcatacctctctaactgagttggtaattttttgaggataaatgtcatgctaaatgccatgttgtgtctcccagagtgcctggcatggtactccatttgtaggaggtgggatcttggataacattcatcaaacacctttaatgtttgacactgcctttatctagccttccttccttccacagctatccgaaggcatggccacccagcagactctccatggccttcaagccttcactaactactctattggagtagaggcctgcacctgcttcaactgttgcagcaaaggaccgacagctgaactgagaacccatcctgccccaccctcaggactgtcctctccacaaatcgggacgctggcctcaaggacggcctccttccggtggagtccccccatgttccccaatggtgtcattcacaggtaatgggtcaggcagaaggatgaagaaactaacaaggcatgtgtacagacatatgaactcatggtatagcctactctgcacctaggctacaaacctgtatagctacctggcactccccagggaggacttgcttattgaacagatatctatagcaaagtagacaaacaaattgatttgagtggtaatgttacctgcgatgtatttaaatcataaaagcaactaatgatagaaaggagaacaacgaaatgttttacattaaaaagacaatgcaatgtgttcgtattcaatatgctcttcctaatggttatctggaagcattccttctaccagccttcactggaacataagatacctccacagttaaatcagaattgccctgatctaatttaaaatattgtcataaaccactgtttgaaaggaaaaagaagacacttgactcaaaatcatttagaaaaaaaattatttactctaaaaagagaagaaccatttatgtctctcctcttaaaagagggaaatgtcttatctctaccaaaaaggatcactagttgctgggtaaacagcaatgtgtgtgtagatggtgacttctcttatcatttctctggttacatctgctgctcgtttccaatagcattacataaggtgtttctgagagcagtttcctgcaaatggaaattttaaagagcctgtagctctgtgaaaacaaaatgtctcctcacaaaatagaactggttttaaaagagagagttaaactaattccattacccgtcttgactctacgtatccattctcattttagctatgaactccaattccacgtggcttgccctcctgactcagccctcccctgtactcccagccaaatagaaacaaagtacacggggctggggcagaaagccagccttgggggtctccagccctacaccacatacaagctgagagtggtggcacacaacgaggtgggcagtacggcttccgagtggatcagtttcaccacccaaaaagaatgtgagtataagtggctgctaccataagccagagagattggaatgtggtcaggagaagcttgccctgaaactcggagaagccacttttaaaaacagattgagtgggctcaataacactgaatgttactgaagcattgatgaggatgactactgaggaaaaatgcctactggatttaataatatggaagtcaagggaaaatttaagaaggattttcttgtggggatagggtaaaaataaatttaggggaagttaaacgatcaatgggaagaaagaaaatgaacaaacactggtagaccatttttataagaagttttgctactccttttctttgtaaattacatggcataatctctagtatgtccagagagcattgagacatagcactattaggaaaagcaaaagggcaagtgagtgaaggaaagagcaatcaactaattaattgggggcttccttacatttttatataatacagtcacgcatcgcttaacgatggaaatatgttctgagaaatgcatcgttaggcgagtgtcgtgaaaatatcatagaatgtacttgcacagacctacatgttataacctactctgccccataggcatgtgactgtgctgaatactgcaggcaattgtaacacaatggttatttgtgtatctaaacatagaaaaggcacagaaaaaatctgatataaaagataagagggccaggcacagtggctcacgcctgtaatcccagcactttgggaggccaaggcgggtgaatcacctcaggtcaggagttcgagaccagcctgaccaacatggtgaaaccccatctctactaaaaatacaaaaattagccaggcatggtgacacatacctgtaatcccagctactcaggaggcttaagcaggagaatcactttaacccaggaggcagaggttgtagtgagccgagatcacgccactgtactccagcctgggcaacagagcaagactccttctcaaaaaaaaacaaaaaatgtaagagatggtacagggcagctccattataatcttatggaaccaccatcatttctgcagtcttgctcaaaatgtcattatgagatatatgactataacttagattttataaggtatatgctttcattgtttaataatggcaaacacaaaaagtattaagaataataagtgcttatcagaaccaactgcataatttatggagtccagtggaaaatgaaaatatggaatcctttgctgaaaaatctttaagaattccaagacagtaacagtacagcatcaggctaagtccaagactcttctatgtcacaggcccttgcaacagcacaggtcacatgccaaggaagctggtccagcttattataccccaacccagaggcaaccactactaatattttggcataatcaattcttttaatctcctttctatgggtaatttttactatatggctgaaatactataactaaaatttcatagtcagctttttatacttgacgttattgtatttgcatttcccgtggcattaaaaaaactctttagccaccaattttaatggctatacaatattccatatataaattaattgggacattttgttttttttttaatttcccattaataaatatgatgaaaaaatctttgtgaacagatctttgaatgtctggttatcttcttaaattaaattttgacaaatagaatttgctattaatacatcaagtattttaatattttaaggctttggatactagtttcatgtttgctttcaagaaagattatgtcagattataaatcttacctaaaatactctatctggcattgaatatgatgccaattttaaaagcaagaattacgcattcataaagaccaatgtctcacacaaggagcttaatgtgtctgagcaacaacatggtaggatgttagtaacagatcacatttacagaggacttgtttgttcctggcagtattttagcattttacaaataattcttacaacagacctattattatccaaatttacagatgaaaaaactgaggcagaactataaactgtgtactgcgattccaggatgccattcatatagactatgatctgaactgaggctcttggagttagacagtgacgtggccctaaactaaggccagagcttaagtaacctggccagtttccacatctagtaagtgcagtaattactctgaactcatggtcactgagctcagctgctgtctcagtactactctttccctgatcaattcatttcctactctctgtaatcaagacttcaaaccatctccaccttcgccaaacctccctctgccgctcaccctttctcccttcatgcccacaacccagctcacccatttctccctttattctctgcagaactccttgtcttgtaattttccaggaaaagagatgtcttcagtcagtaatttgctccacttcccactgcagacaaagctacctgcatataccccattgctgtcagtgacaaggaaagggtggtccttcttccgtctgaaataaacctgccttccatgcagtgaacttcatccacttcattactcaccatcccttctctctccttaatctttctgtgtatctcactttgattcaaagttccttctacccttctaatgttaaagcaaacaagctcctcttcccctgcagtgatgtggactctactctctctgacagcaaaactttcctgaggaacggtctgcagatgctttgcccatatcctctcttccacttactctttaacttcctcagcactggatgaaaatccctttctaagtttgcctttggcctccatactgatatatccagaaggcatgtttctccaggagtcaccttcactgactttccagtagcattcaacgcaactgaactttcaatgttcaatccttttttaaaaagtggtttaccctcattttcattaccaccctctcctggtttctcctctacttctttggattttcatttttagtcaactttgttggttgatcttcttccgctgcccaaatcttaatcctaaacattttaactttgtccccttgccgtttctctactccctcctttcctcctccctcatcaggtgagttcatctgctccaaggctttggttccaaaagccaaactccagtggtcacctcctagtcaagtgctctgttttgaagtgtatacccctccacccagattcctcacagacatctccctctgaatttctcataaccagcttacattggacaggccccagacagagcttgcaactttccccttcaagctatgcttcctttagtcctcactttctccattttcatctccagcactgggcacagtatcttagattccaatcaatgttgtttaatgaataagcgagtgcacctaacactgcatgtttattgttgacactgctcaatcagcattttttgtcacccatactatattcaaagcaaactgtaatgattcttaatgtgtgctgtctgattttgtaatctcctttgcactacatccagaagccaattttgctaaatgttgcagttttttggttgatgtggccagaaagccagagaacagctaggtgagctttgtaatttataaccaattcccttttgagtcatgaagcttagcttttgccagaattttttttttcttatgcttggaagaacaaagtgaactgatttaagattttcttcctgtggccaggcacactggctcacacttgtaatcccagcgctttgggaagccaatgggggaggattgcttgaggctaagagttcacgaccagcctgggcaacatatcaagacacctatctctacaaaaattttttttttaaatagccaggtatggtgacatgcgcctgtagtcccagctactcagaagactgaggcaggaggattgcttgagtcctggaagtcaaggctgcagtgagctgtgatcatgtcactgcactccaaccttggcaacagagcaagacttggtctttaagaaaaaaaaaaaaaggattttatctatttgtgtttttttatattggagaagcagcttaaacctggactagcaccataggagaagaggttcccttaatccactactgggtcaatagttacggaaaaatacaagaaatgactatgatacaggttctaaaataccacttatgctacttttaactcattataaatactgggagcacgaaaacatgcaccagagaatacaaaccagaaaataatttggggcctggtgtggtgtctcacgcctgtaatctcagcactttgggaggcagaggtgggcagatcacttgacgtcaggagtttgagacgagcctggccagcatggtgaaaccccatctctactaaaaatccaaaaaaattagctgagtgtggtggcacacacctgtaatctcagctacttgggaggccgagtagtgagaatcacttgaacctgggaggcggaggttgcagtgagccgagatagcgccactgcactctagcctgggcaacagagcaagagtccaactcaaaatagtaaccataataatttaaaaatagaatatgcagttttatatagatgtgatcacatgtacactcagcaacgggtctggagaagaagcctaacaacacatttagttccctctgcttgaatcccccttcagtggagagagaggtgaggtgtaaatgtttaacagctggcctgcttgagggaaaaatggcctgatttgaagtgcttatcagtttccatggtgtgaatacccccattactgctctcaagtgaccaacatgacagcactgaacagagttaggaagggatgggttgtagcgtatcattatataatatttccaccagccagatagagtggatgtaaatgacctcgagcacacagacggtagtaaaatgtagtgaaacaaataaaaagttatgaatttggagtatttataagctttgttttaatataatttatttaagtttatataatttaatttttagtagtggccggatttaacaatgactcacaaaattcctgaatatttaacagttggggtgagccaacttcagcacaccactggagagcacccatagggtgaattggtaaattctgttcttttcaacaaatgtgtaccgatgataacaaagtagcatgggccttatttaagcaagcctaggttcagctccttggtctcctaccagccactgacatagagcaagatatttgacctctctgaacctgagttttctcaccccaaaaattaggaatcaatctttacaggattattttgaggattaaatgagataaagtatgtcaaaagctaggagcgtagtggtacttacagctttttcagtcttccttggggaggatttgtaaactcattattctcgattattttaattgcttactctttttcctcaggaaggtctccaaaccctacaggacaaataagactcctatctttctattttcttgctagttacaagctgtttctttatctgtgctgttatgatatagggaaaaagtgaaaatctactgaactaaggtgatggagagaagtcatagacaaataacaatagagtattccttgtgatatcaggcagaatcaatgttggaaaagcattgagatttaaagagggcttgataactcttgttttggtgtttgcagaaaatttttcttatggctttatgaaaatatcttattttgaaagataacaatcaactgtgtctttacggttgaatattacaattacaaaagcataattattccttattttgttatatttcctaacatcagaaatagatggattgatttttaaagaaaaagaatcagattcaatttagtctcactactcactcctttcttttcttaaaagccaatttggtatataggtgaatcttaatgtttttacaaatatattgattattttgtagaaaataagatctcatgaaataaatctcttctgacttgacaagatgacatggtatcccttcatttgtttccacaaaaattattcatttaaaaggtgagccccagttaaggattttctttttgttttagtaaggaactgaaaaatcaagagaatgtgcctgtgaaatgcacacaaagttgcttctatatgtgatataatacttaggacacctgagcttgattatatactaatgtactatgctattgattgattagtcagggccatgaattattatacttgaattactgtttgcaaggctttttaactatcttagaaaacaaactaacagtttgagaaaaagctttaacaataaatgggtgccaaaaggacgtaattcaccatctaagcagtttggtttggagaaaaaaatatattaacttcatctagtccttggggctttgtggcaataaatattgatttgatatgaaaaatagctatctactgtacttaatagtattaaggatactttacctgttaaaaagagggaaaatgcaacaaaatatgagctccagggttatgctggtgagcagatccattgtatgttaatagttttatttataaaacaccactctctatcgattttttttaaagcaggcataaagttgctgagaaagcatttcacacatgttcccattggttttcttttcacccctgatactggttgtttcgtaatactgaggaaaaagtgaaggattctagcaatgttggttttcttttttttttttttttttgtttggattggttcggtttgattttgctcatattttttttttttaaagtgcacacctgcactccttcaaagaggttaccctttttagaacatacaactttctccccacagtgcctcagtaccgagccccattttcggtggacagcaatttgtctgtggtgtgtgtgaactggagtgacaccttcctcctgaacggccaactgaaggagtacgtgttaaccgacggagggcgacgcgtgtacagcggcttggacaccaccctctacataccgagaacggcggacaaaagttagtttctgactcctgtttctcagtgtggaaggcgctctgttccccagctttacgggatgctaaatctgaaagctgaccagcagatgctcaccattaaaatgtcttggtttaagtgcccccttcttgtgaaaaagttactgctcaggataaataaggttttctttccttcccatttgcagcttgacagcactgcagttataatgcagttcaaggggacagcgctgcctccacaggactggagggtccccaggaagggataagacccaagggccagttgggttcacaaaagaaatagcacccatacatagtcaatgactaccctaaaataatacacttctagcaacttcatagattttcttgctgtatctccagtctccaaacagagccctatcaggaaataactatctccaactcatgaggacctgaataaggggtttccttaaccttccttgatatcagcccctgaaagaacaatcttgaccctctaaaatggagttccttcttcctgtttacttacatgtcccttttctccttgccttgtttttaaattgaaatgagaaaatgctttacaaggtgctaagtattttatagtgatcagcatgctcacaggaccaatgttcactatataatgaattgattaatgagtattttattttggctgtaaggtagaggtaaacagtgagctccagcattgcatgtatagtaatagaaacttaataacatttttacaaagattcagctacacatgttcattgttacagttcatggtcacctgggcagctctttgggaaaggaaggtggcctgatggttgggagacacaggttctacctggccaggcctataaccatctgtgtgaccttgcaagggtcacttccctcaggttcctggccattggaagagcaatttagaccatgtgatttctaggatcccttttgagctctcctgttcagtaagaaactctaggtcatttagtggaaagtacacctgtaaattttaaaggaaggatttaaaccgtgtgcagaacaagatgcgctttgtgtattaccctttactcgtctgatgttcttttcctttgctgtataagctctaattttccttagctctattacttatggataggctattattacactaatgatagctttttttcttaaacattttaaaattagaagtaattttgaatattatataaaacgtcataacttgctttggaatcctatttttcatgctatgatgcattgctcttttaaaagcatgtgccctatttgtaggtgttgaatgaacaagtcatttaccagttcttccttttgtctagccttctttttccaggtcatctgcacgactgacgaaggaagtgttaagacgccgttgatccaatatgatacctctactggacttggtaaacaactcatattatacttggcgtagcacctattcatcttcctcaagaaacacacatatgtttgtttatacatacttggagtcctaatatattagcatagactatacagaagaaattgtgccaagtgttgtcagagtttttttttttgttttttttttgttgttgtttttttttgagacggagtcttgctctgtcactcaggctggagtgcagtggtgcaatcttggctcactgaaacctccacctcctgggttcaagcgattctcctgcctcagcctcccgagtagctgggattacaggcacgggccaccacacctggctaactttttgtatttttagtagagacatggtttcaccttgttagccaggctggtctggatctcctgacctcgtgatctgcctgccttggcctcccaaagtgctaggattacaggcatgagccactgtgcccagccagaaattttttaaaaagtcctcatggaacttatatcaggcaaggagttacaatacactctttttttttttttttttttgagacagagtcttactctgttgcccaggctggagtgcagtggtgcaatctcagctcactgcagcctctagctccaggttcaagcgattctcctgcctcagcctcctgagtagctgggactacaagtgtatgtcaccacgcctggctgattcttgtatttacagtagagatggggtttcactttgttggccagggaggtctcgaactcctgaccacaggtgatccacccaccttggcctcccaaagtgttggaattacaggcgtgagccactgcacctggccagaatgtactcttaaaatgccaaatattgaattgtaaatatggaaaagaccagagagctcaaactaaatttttctcctaaccacaaaccctgtcaataaagaattgtatgacttcgcgtgcataaaggtgatttacagaggaagttagaggagagatcagaagaagaaagaaaatattcagccaattcatgttgatcataatgttaatattctagattcaaagcctagaatgataaatttggaaagtgtcttttattctccataaaagattatgattgactgttgatatcgggtaatttagctcaacgggtacaattttaatttttaaggagcatcttttaaactgagttttactcatagtctctgaatctaaatttgtgatactttataaaagcaaattagagaaatgccaaatcttttccactaaaacagattcgggattgatatcctattttaaattccagtaattaatgatatatcaaatttgcatgtatagagtttttttttgaaaaataaacatgtccaaaatttctgaaacacaatttaaaaaaaaaattttttttaatttttttgagacagagtctcatacatgatgaaacatgtatattattgtcaaggatagtttcaatttgtaaaaataacgtattattctatgtttccaaactttacatgtctggatgtcatataaaatttcctacaacacttaattcttctcatacggcttatttcatttaatagcagtggtaggatagaacagatctcatttagtattctgttagcaactccaatatttccccaagtggacaagtggaggtataagggacacaggaatttatccaggaatgctctgctagcttgttactgggatgagaacaccaacacagattttctattgacttctggcctgggactttttctttgcaatggtttgccaagttaagtacgcataggaatcacctcatgtgcttgtttattgtagtttcccgggcctctggcagagattcagactcaaggaggctcagaatctgctctttaaataagtcctgtccagtgattctgacacagggctcagaaccacgtgttgagtgatgccggaaaaccaaggttgctcgccttctaagccctgccagtctagtttccttggtgaatgggaagtgtgttgttcctggaggcaggccatcaacagagacggatttactctgacactggctgtggtttcggttttctttggatctgaggcccagccaccagagtttcaaaccctgacagtgaacctcccatgtgatgcacaggtagagtcccttaaggtgaaggggtacttcaaaaagacagaagggaagggataaagggacaccatcctgatctcgaggtcttcataaaaaggagaaatcccccgttggctcatgaatacgaattgaggtttccactgtgtctggaggccgggctttgggtagagcagaggggaagaactctgaggattgtgcaatgctctggcagattccaagatgtgctgcccaactaatatccatcgtcagttctaattttcatgatgtaacttttttaaaaacattcctgttcccttgcctgaaggcagcctccaagcaggagagtggcagagacctcattttcctctgactgttctaagggctatttcccttttgaggcttccctcgggcaggctgccctcccttcccctgcgtgctgtggagcaaggggcccactgggcccatcagatcagtttctggagttacagccaacaagttgttttctctctgtgccacacacagaggaaacaactcttttagtgtgcaacctaggctggtttgtttttaatcaaacaacacacattggttcctaattaggggaatttcgacctgctggagcttgattggagtgttgactcaaccctttattttagagatgagaagcaaaggtcagagtccaacatttaatcacagagctgatcggcagcagagttagggttggcaaagtaatatccctcctcttacggagttcaaagtttagttttagtcaccatctgttcctgcctttaatagtttcaccccagttctgaacttttttcctttaagtctttccctgctagtgtgagtgtgaagtaccacgcaggcccatggagttctagaggtgttgaaaagggggagatttgtccagtgagtgagtgggctttgcagttgtgtctgcttgttcttctgacctggctgtgggtattagatttagatgagcagctctctggctcacatctccacaccagcctgtgtggccgctgcatcagatccacaggtttctgtgctggccccagcagtggctggatgggagcagatctctggccaccccacccccacccctgccgcacccctgcttagcttgccaagctgacaacataatttcactgccttcgcctatcctgcatgattcttgtcagcctctctcctatcttccccacaagacttaataaacctgcctggctgggtgcggcggctcatgcctgtaatcccagcatgttggaaggccgaggcaggcggatcatgaggtcgtgagattgagaccatcctggccaacatggtgaaaccccatctctactaaaaatacaaaaattagccaggcatagtggcgcacacctgtaatcccagctacttgggaggctgaggcaggagaatcacttgaacccaagaggcagaggttgcagtgagcggagatcacaccactgcactccaacctgggtgacagagcaagactccatctcaaaaaataaataaataaataaataaataaataaataaataaaaataatcctacccacccttcatccctgtaaagctctaagcataggacctggcaccaggtacattcttgttaaatgtgagctacttttattaatactaacttcatgtgcagagactcacaccaactgaactctcaatgtgtgaacgccaagcaaaggtaagtggctccagtgctaaaagatttctttccataggaagctttcccagtgcatttgggtgatggtttgctgagctttgctctttaacagagaggccatgtaaagacaacatggtagcaaacacaggctgttaatatcataatggaaaatggaatctgatgcttcaaaatccagtttgcacgaagtatcaggaattggactgttgcatgaagcaagtacacctcagatctccaaggagtgattttgtttgtgactctgcagcaataatagtaagggtcccagtccctcatgagaatccaagcaaggactttgctcccaagacacacagctatgaaacaggtgaccctcaaggttactttggtaacctcttttaaaaattgctccccacactcccatctttcccagggatttgtcaagacagtggtgatttccaacctgagcagcagcgccagaagtgtcagcaaggcctctcaagggctgtaagcatctcgttataacccagcaacctgctgaaccattaccccaggctgcacacaagtgcaaacaagcagtaagagacaaactgctttctgctttcaactcctctctaatttactatcaaatagcagggccagagatgacaaaaatgctttctgaaataacatttcccctttctttctctgggttttgcaggcttggtcctaacaactcctgggaaaaagaagggatcgcggagcaaaagcacagagttctacagcgagctgtggttcatagtgttaatggcgatgctgggcttgatcttgttggccatttttctgtccctgatactacaaagaaaaatccacaaagagccatatatcagagaaagacctcccttggtacctcttcagaagaggatgtctccattgaatgtttacccaccgggggaaaaccatatggtatgtttgtagaggtgtggccccatttccctatcactggactagaatacttgttttccttctgagaaaaatgtgtcatagccatggtaacaaggaattagatgtaagttatgtttcactaagtgtggggaccaagagaggctaaccctagaacagctttctcaactttggctgcacattagaatcacctggaaagctttaaaaaatatcactgcctggacttcatccgagaaattctcatatccttggtcttgagtagggcctgaagattggtattcttttcttcactccaaaactgattttaatgtgtaactagggatgagtatctctgccctgtaattgtaagccagggcctggtggagaagagttgtatgttgagattacctggggaaattataggttgtattactgtgtaatttggtggcggggaatgaacattaaaaggcggagatggggaggaaggggctacagtgctagtggtgctcggtctgtcctctggtcctgacaccctgtgccacagaggatggatggctcctcttagctatagaccactcactcccaaaataggaggtccagtaaaggtctagtgggagagggccccatcacttggtattacaggacagtcattgcccagagcactcattgaagggtaaaaggtgatttaattccatggtgcagtctggtgtggggctatgtctacctggaggaggaaaggctgcgttttctaatcctcatcaggtacccatctgttcaccaaagctgggcgcccacagggctacgtctccctgaggaggtgccttttttccagtttgcactaaggttctatattagctagtggctaccctaggcagtactaaaattaagcacagaagcctggtcaagctgcttacacttcaacatttaaaaaaacagcagtgagtgaacacagcagcaccatctgccttccagatctcttcacttttccagcactcagcaatgaatgaccactggttaagccccaacatagctggatcagacctaagtagcaggagtgttgggagcacaaaagggcagtgggccctccgaggtccacggtttgtggtttttgtgggaagtagcaatgggacaatgacgtggtggtggagaagcaaagaaggcactgcccaacaccatcagggccttggctctctactcacatctgtcccactcctctactcactcatcctcctcggagcctccttcctccctgagcccatcagacaagctctaaccacagggccattactgctgctgctccttgggtggctcacactcttgcttcattcacatctctgcacaaatgtcacctcccattctatgtaaaatttcctagccccttaacccacttcttttcttttctatagcatttaccacataacactaagtcagatatgtttgtctgactcctgaaatagaaggtaagctcccaggatcaatgatcttgtgggcctcttcctgttgtatgtgccccgggacccagaacggtgcctggcatatcataggcactccacgaatgtttgttgaatgaatgaatgtcgagtgatcacttcgaaccatgggctgtttgctcctgttcagtgaatagtcattaggagattctcactgaagagcagatatttcaaaatttttccttgttaaagaataactttctttaaggagcccatgttcctagaaggtgcactgctgctggaggaaggcagtggaagagagaaaagaaggcaggagagatctgtttagcctgggagatgagctaaactgaaactagggtctatggagtgcatggagtggtgaaagggaggttcccaagcactgctaggcacatctactgtataatgtgaggtgcggttacaggaaagtgtacccacataccagcaatgtccagaagtcatttcagtgatactttctcctgtcctttgacccagtccctataggcaggcacctctgtgtcagaatcctccatgaggaagaacactgtcttccttacttggttaacttagtgaccagaagacactcccatcattcttgtggagatgttatgttactctggatataaccccattgctcagggttttaatgagtcttgttaagcttcgttttgtcaaagtgaggaccatgaactatctgcatcagcatcacataggaggagcaggacctgaagttctgagggagaaactcaataatctgccattttaaccagaacctcaagaagtctgggccaggctcggtggctcacacctgtaatcccagcactttgggaggttgaggcaggagaatggtgtgaacccaggaggcagagcttgcagtgaaccgagatcacgccactgtactccagcctggacaacagagcgagactccgtcacaaaacaaaacaaaacaaaacaaaacaaaaaaagaagtctgatgcacagcaagatttgagaacagctgaaaatgaaataataatataatacaaaacctgtatgcagtgtactgtttgataaccagtagaaacaggtggtgggagggtgctggttagaccttgctgtcctgacaccacacaggctaagccgcctctggggacagacttaggcttcagctgagaaaagcggacaaaagaatgtaaacaccctgttcctgcacaccctttaccatcggggaaatgcacagtggcacccaactgattctttcactgagtggccaagactgagtcaggtgtgaggatgggaaggcatagagggactggctggctgccaggggctctgggcccagggaactggctcatcctcagcagggaagccattcattgcaggcaggtctcagcagaagtgaaatctgggatacaccagggcaccgggtggaattcccctgagcctgttgaatcataatttaatcctatccagttgacagtgtatttgcaagtcttcttctgttgctttttacaaatatttttaaaccaaactgctctcacaaagttggagaccatgagagacattgtcaaaaattagccaaactaaagagagtacaatttgtattagtagagcaaaatgaagtccctgttggtgactgtgggctcctcatctactcaggtgggaaagaatccagtcaaggggaagaatctgaataggaacaagccagattcacctgctcagttttccagattgactgtcttttcacttgagtaggtcaatgagctatgcccctgcaacacccacccacacacacacacacacacacttctccccctcatgtgacaagctctggtttcagtgctgctgtgaccctcttccaagcacccgtcttgtgaacaggtaagataccctttgaacatcagacccaaactggcaaaaggattttaggctatactctgaatggagagaaataggcagaggtgccaaggaatgagagtgtcttttgtatttcatcaacatttttcaagaccatacagtatacagtatagctaagtttaagttttgcttgttatttaattactggtttgaagatcctttcattccctgcaatactaaacaaatactggcagtggtacttaccttagacactaatcaattaatttccactcaccaaggtttttttttttttaatttgtttgtttttgagacagagtcttctgtcatccagactggagtgcagtggcatgatctcgactcactgcaacctccagctcctgggttcaagcgattctcctgcctcagcctcctgagtaactgggactacaggcgcccgccaccatgcctggctaatttttgtatttttagtagagacggggtttcaccatgttggccaggttggtctcgaactcctgacctcaaatgatccacccgtcttggcctcccaaattgctgggattacaggcatgagccaccgcacccggcctcactatgaagttttagttgcaaaacccaactttctctctctcatatatatatatatatatatatatatatatatatatatatatatacacacacacatacacatacatatatattcacatatatatgtatatatacacacacacatatatatacacacacatatatacatatgcaggtatgtatcctaggatatatatgtacatcagagcagtattaaatatgggtatgataatgctgtcattggagaaatgcaaggaatgtgtttaaaactgttccaaacatggactgatgctgccatttgttctcagtttgactctgtggctgatatatctgatgtgtcaagcaatgtcaccctaaaaagttacaccatgcactttgaggtacctctgtgtgctgcatgaatgcatgatcttttgcatggtgtgttgactgcacagtgaaaagcaggaacagatcattgatgacttccatatatccattccttggaaagctgaacaacatgagtgaaaactctactgaaaaaagaaaagaaatgggaggccgaggcgggcggatcacaaggtcaggagatcgagaccatcctggctaacacggtgaaaccccgtctctactaaaaataccaaaaattagccgggcatggtggcgggcgcctgtagtcccagctactcgggaggctgaggcaggagaatggcgtgaacccgggaggcggagcttgcagtgagccgagattgcaccactgcactccagcctgggcgaaagagcaaaactctgtctcaaaaaaaaaaaaaaaaaaaagaaaagaaaagaaaaagcagaaacatttcattgattggaccagctaaatcagagccctcagatatttagagcaactatagtttatcttacggcgcgttctaggtctaaattatgtagtgactttttctctctgatgttaatatcagacctgatgtaatttggaggctggaatcctataagaaatggaggaatatggaatgagaaatgagggagggaggagtcaatttccctacacaaatccaggacttttaaagtgaaagacaaacggagctcacatagtggaccaccatgaaataatattgttatctttggctgttctgggggaggagtgttctcaagagggaggctctgtgctgacatgtatgaagaagataccttgttcacccatcatccgtctgccttgccccaccactttgcaatgcagcaagcccttgccccacagggaacaacagccagagcaccagtgcatgagctctctaggtgccgaaaacactggccacctaacttgagtattagctcatcatctcatccttcttaccaagaaacccagggtcaccgtgttgtgggtgctcatagctgctaaattctgtaggtgacagttgttcccttcattgacaatgtgacaattgtcaggagacagtcattcccttcactgacaatgtgtgagacacaattctctgtcatatttcaagcccatattctttatatgtgaaatactcacagcaacttccttctcaggggttagccgataccaaaattccccggtctgggacacctgtgagtatccgcagcaaccggagtgcatgtgtcctgcgcatcccgagtcaaaaccaaaccagcctaacctactcccagggttctcttcaccgcagcgtcagccagctcatggacattcaagacaagaaagtcttgatggacaactcactgtgggaagccatcatgggccacaacagtggactggtgagttggtttcctcatacagggcctttgctaaatatcccagaaaaaatattggtacagagctgcctgtacttcaccgaatgctgccccatggcactcgcctctgagcacttagccagtgaggtagtaacaaccggtttactaatgttacttcagttgtttgataagcagggtagaaactttgtcttgttcttctggtatgcaatagatgcttaaaaataaatgcttattggctagccgtggtggctcatgcctgtaatcccagcacttggggaggccgaggtgggcggatcacctgaggacaggagtttgagaccagcctggccaacatggtgaaaccctgtctgtactaaaaatacaaaaattagccaggtgtggtggtgggcacctgtaatcccagctactaggggggctgaggcaggagaattgcttgaacccaggaggtggaggttgcagtgagccgagaccgcgccactgcactccagcctgggtgacagagactccatctcaaaataaataaataaataagcagcaaacaggttatacttcatatacttggagcagatgacaggaaacattggaatgggcctaaaacaaggcataaaatacaagcacttgttttactaaaacaaaaaggtactttttttgttttgccttttcctattggtgtatgggtagacgcaaaaagaatattttgtatcaacaggtgaacatggttgctttccaaaaccttaggaaatgatgacaaatgagggtgttactatttataagcttcatctttcataatttcagtccagtgggtacaaatcattggctctttgaaaggtaacctcttcgtgatataacatttattatcagtctctgagcggctacaataacaaaaatcctagaatttttgccaactatcaaatttcattgtgctaacttcctagatgcccgctgcagtacctaccattccactgggcctgttagaaaataaacagataggccaggcacagtggcttacgcctgtaatcccagcattttgggaggccgaggtgggcggatcacgaggtccagagttagatagagaccagcctgaccaacatggtgaaacctcgtctctaccaaaaatacaaaaattagctgggcgcggtggtgcgcacctgtaatcccagctactcaggaggctgaggcaggagaattgcttgaacctgggaggtggaagttgcagtgagctgagatggccccactgcactccagcctgggtgacagagcaagactctgaaaaaagaaaaaaaggaaaaaaggaaggaaggaaggaaggaaagaaggaaggaaggaaggaaagaaggaaggaaggaaggaaggaaggaaggaaggaaggaaggaaggaaggaaggaaggaaggaaggaaggaaggaaggaaggaaggaaggaaggaaggaaagaaggaagggagggagggagggagagaaagaaaagaaaagaaacataaccagctaggaagttagctcctgtgtttactcctctggggtaaaattattcacctccacttctttcaatcatctgcttctgtttttggatttgctctcatctttctcctccaagttctcacttttccttcactgaaaagttgatgacttccatgaagcctttcttgactaatagcaaataataaagggagttcgctggacccaggttccctaacactatataaaaaaatgtaccatccttctggcctgttcagaatgattgtataatatatacatatatataatatgcattttaaaatcacaggctgtttgatgttgttgtaacctcaactacatgagtccatttcagatctaaagtttttaaaaggcagggataattatatttggttgaaacaatgaattgctaactgatcatttttgacatgcaaaacagcaattgctatacattcaacataatacattgaaagttcagatgaattattacatctaatcttcacaaactgtaggaagtaggttctattatcatcctcattttttacaaaaagaactgaggtttagagagatgagtgatttaatgagagattacacagctagcaattatttttatgggtttgggttcttaaaaacatcatctgactacagagctcctatttgtaactattatactgtattgtcatttttgcttgctttttacggtactaataatgggcaatgtgcaaagggactcaataacaagcttttgaaggtgccagtacttggcaagttatctgtttattataacattataaccaacattactaaccctatttgataaatacaaaatacagcacaagagtgggaagaaatggagcacaaatagctagcattctgcctcttccatttaccgtttgaactaaatccatatatatgtgtgtatatatatgtatatatacagatcaccagaggtcaggagttcaagaccagactggccaacatggtgaaaccccatctctactaaaaatactatatacatacatacatacatacatatatatatatagtgtatatatacactaaaatatatagtatatatatgtagtgtctatatagtgtgtatatatatactaaaaatatatatatatacccccagctaatttatttttatcaagtatatatgtacacacacacacatcccactctacagatgagtagactgaggcttctgaggcttaggttaaaatatgacacaatataaccctcaaatcacatatacattttgaattagtctatagttcatgtgtgcatgtgatgtgatcctttcaataagagaaatttaaggcaaggtctgttttagaccccaccatggtgttgagaataaaaaagcctttaatacttattactttttacacttaattgatataactataaattgatagcaaatactattgatagcaagtatgtagccaatgatgattggcttatttttcagtatgtggatgaagaggacctgatgaacgccatcaaggatttcagctcagtgactaaggaacgcaccacattcacagacacccacctgtaaaggatggaaacccagaagacgtaaccctggaatgcaaggtctgcacccatttcctcctgggttatcactcacacatcataaatgctgaaaagccattgtttattatcctataattctttaaagaaatgatgactgtttttgaaagtgttccttcctaatagaggtctaagaaatgatatttttctcatcttaaatgagagagaatattcatatgaaaatacttgatttgctcttattttgtagaagacaaagaagtatgtaattgtcacttggttctgtttggcagtgatgctcctggttaactgaataatcagtggcaatttcaagatggctcacagttgttagaagtagtaagttagttactggctcaaaaatgattctgttgaaaggatgtcactgctgttcatttctatctgccatttctgtcagggttgacacaatcctgcaagaatagttattctaatgatcacagctgctaaatgaatcccaaactttgcaccaggtcgacaaacttttctgaaggttctatttatttaccatacatagggttacttaccaaactttttgacaaggctgaaggttctatttatttacaatacatagggttactcaccaaactttttgacaaggcaacacataacttacacataaatgtctctgttcttgcatttatgaattttccaaaaatctaaggagtaaacagcttatttatacattttgaggagaaaacaaagtgtttcactaggaacacctctacttgaaccaatgtttttatttcatatattttatagttttgaaactagtttctcataaaattctgtcaattcactgaatatcagagaatactgacatcttcaacctagcacatttcaaatggaaactactgttctatttgcaatattaggctgcgtgaaattttaaaaggaaaaatgtatctgttccttctagcattaacatatatacatgtagagacaagactatacctatgtgtatatatatgtatatcatgtatatattactctgcactatatcccttctttttggagaactagccattattttagccacagaatcagtaagaacagatgatatgcaacagtaccaattacggttcaaaaatgtctgtcacctgctctagttggattacaaagtcattggtgaaagtcctatggcaagaaaaattttcttgcaaatcatccacataaaatcagatatttaaatttgttcttcatggaaaacagagtaagaaaacctcttgtcttccttcatccttaaaggtctttgtgaccccaggaaaatattgactctgtctaacacacaatagtcacaatactttttgtgaatctacaaccagagacaggcaaaaacttgtaaagtaagggatagtcttacttattctgcctgaaaacaatgtattaccccagggcccaacagtaaaagattgtggactttttgggtattgagatttcatctagctctgtgagagagcagctcctcagactgaccaactcctagacaaagtttgccaaccataagtgtcaaaagcacaggccagtattaagcagaagttctaccaccttattagaactgctataaacaaaagcatctgaaataattgtgcacatctggcagtgactgtagaaaatacgaaatatatatttctcgccaagtttttatactttctgaaatgaaaacataggattgactagtttactggtttttattcccatatgccgattctgggacaataaagttgtttaaagctggcacaaataagcattaaccaaggctgtgtccaccttctgtgagctacttaaggtatataggaaaggagtggtcacaaacttgcatcctaatccttggtggactcttctaagaatacagtttgctagtcacaaagaatagtctacaaatatgctttgctaggttcagaagattgagtttatcctgatttttgaaaaattaaccaggtatctttatcactgtgtatttttccaagcacagtataaaattttaacaacgcacaaaaaaatacagaactgcaggggattttatcttggatcattatccatttaatcatctaattagacatgaactcagttagctgaatcatttacattttgactccatagcttagggcagacagaagcctgtatggcttctgcccagaactctgtcccctgctacatgtctaagtttacttgtatttatttcagagaagaactctaagatgttgctttgctactttaagtggtattgcgtgccaagcctctattatacaaaccatgcagactcgcctctagagattctgattcggttgatctggggtgtgtggctgaggcatcagtactttttaaagcttccaggtgttctaatgttgagacccactgatgttccacaatctggaagaaatcatgtacaggaataatatgctatgcacagggactatgctccttggctcaccccttctcccttataaacaatgagcagttcttgatgaacctctttaaatttaaatctcctgactcacattttaccaattgtacatgccacattctcagcttacgaactaccatgttttgttattcttaatatcaactgtttggtaagagtacagttgtttttatacactctaagaaatgtgtttataatctactgtaatttccactaaatggaacccaaatattaatgttatggtaccatatactgatgtaaaaatcatgctggcatccatgaacacaccggtaaataaaacatagtccaagtggaagaattcattaataaggaacttttaattatgtcacaaatgaatagttggtttccaatgcacaaatatcatgtaaactaatctaaagatggtttgcttaataaatatttgaatgtgacc

SEQ ID NO: 9 - DNA, 800503 bp, Homo sapiens
tgtttgctctgcagaatactttacctgggcacccaagtcttccttccagcattcctgctgctacagcctatttgctgagtaaccaggggttacagcagcgttgccaggcaacgagggacagcggtcctgttgaagagccatttgtcacactgaggggactggttgaaatgcaataaagaaatggtaactcagcttatttatcaatacaattacttgcacagtattagggatccatgtgtaacctacaaattcatagtcatatgaggaaacacagaaacattttgctaaatattaaagcataggacagacagatggtgttgggtttctaatcagctttactctgagcttaaagttgctgcacatgctgggataaggggaaaggcccaaagtcctttgccagctttattttgggcatctgtaagttagctctgggttacaatgtacagtgcatgtgtaaagaaaatctacaagattcttttccctgttaagtagagctggtaatgccattgctaattccctggggtgaagtaacaacacaaaattattgtatgtgtaatatattattaataattatatatatataaaacacacacatatattatataaatatttatgtataactggttataaatattactggttgtcctgtggacttataaagtgcttgatttgcccaatgcaatcaagagatttaccaaaaggatgagtattttactctgagcactgtgcttcaaaatgttttttgagaagttcagtagtgttgcttctaggagctcaaagtcctcaggcctgggatgagcttcagttttaaaggtgcagcagctttcccttgacgccctacgtttttgattcccagataccagcagctactcatgtcttcgccattgctaagaacgtcgttggtattaccttactctgagaacgtgtctgcagtttccagaaaatggagtatcgcaacatcacttaaagtaccctgcttcaaagtattgctggcaagtggcgtgggcctgattatttatttagaaatgctttatcaggaggagaatgcttttttgtaaacatgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtaagtagtagtgtaggtataagctttcataggtccccaaaaccagtagtagtgaagatcatttcagcctgaattccaaaccggaagtgaaggctatatagaattcatggtattgaagactaactcttccagttgtttccccaattaaaatttttttctcttctatggatgaaatggaccatgaaaaaaaatgtgaaaatagtttatcaaaggcaaatgtgtttatgcaggaatcatttattttctatagcttagcgcgacctttggtcttagccttcaaagcctaaagaagactcagagtgagttttaaggcatggaaacttgtaattaatacaaataattaatattttcaaaatcttgaactgggtttatataatcaacatttccttactagggtataacattttcattaggcagatagttctcccagtccttgggactgttttcttcatcctcgtttccccaagaagagctgtttgtttgactcatggaagatgttcagtaatataaattgaatatataaataaccctccatctctaaaaacatatagcttttagttctttatcttgtggtattttcattttccaattagttaggaaatatgtaggtaagtgtgagagattctcaaaagctttcatgctgttcatcccagagaaatgccttcaatgagtctgggtcttattactgccattttttgttatttaatcaccagtttttcattctgtaatcttttctcaagctgatatctaatgagtttcttctaaatatttattgccaacctggagattttaatatacaggacagttttgaggaatttttgcttatcttttttcttcctagagggcttttggccctttctcttgtgacattttctgtgtgtgacagcgttggctggatatctaaaaacttgtgaaacaaaccagaaaaggattacaatctcataagcaaataggacttaaatgtttttggtgtttagtttcaatttgccaagtgaaagttggcatgtcttcattttgttttaaatttggattaatcacaaaattaatcacaaaccattcccatttctacatctctcctcaaagaaaaccttgttttcttactgtttgaaattctagtaaattcaagctactcagtttatataattaacatctgaagagtcttaaaacattgtcttttgacaaatagggctaagataaaatatccttctgagcttgtagggacatatctgtaccaaattcatcttctattgacatcattttgtataaataagacagagaagtatttacagggttggaagaacatggttaatggttttgagagttccttgtatcaaggtcgtttccattttcaaaattaaaatacctttgggaattgggggaatttcggggtgtttgcactagataagtaaaacaaacaaaacatggattatccaattattgtttattcaggagcagaataaatccagttcctaaatattttgctacctgccttcctctcacatttattatctaccaaagctagtatgtttacaagcaaacaaaatagcaaggaagataatcaataacatattaagaaatgcattttcagtaagcttgggaaaataagtctgcatttggtaaatacattcttgagtaatggtcgaattctcacttgtagatttaaacagaagaaaaatgaataggggcaaactcttttcaggttaagacctgatgggtagggataaaaacaaattcacttcagtaaattagaaatattcaactactgaagggttaaaaatataatttgcagtagaatttatataaaacttttatttctacttatataaaacctttatgtcatctaaatctatttgcctaaattaaaaatatacttgcactcataactttataccaaatatacatacaaaatatagtaaaattgtgacagtaaatgagggactattagtgttttacaatcttattcttacctcccaactcaggaaaaaaatagatgcaagtgatagatgcaagtgagaagaaattatgtgtgaaaaacatgccctttaaggaaagctttaaaccatctttagcagtaattcttgattggctcaattttatacatttgcctctctgatacttcctaccaaatttgatcacaaactcatcattttttgagagactactgtatcctaggtgtttgtgtgtgtatcctcagaatactcatgatctaaatgatctaatggagtgtacagatggatgagtgttattacctaggcagcacagtgtgttaagtgagcacaaagtgagacccctcaaccgaccctgagcaggaagaagggtgccaggaccaagcataatcattcagataccaaagctaagtaggaggtaaccaggtgaagaagagacctcaaggtctgaaaggtgtgtcactctaataagggtagagataacttaaaataatttgataactgccctgacacaagacctggaagttttctgaaaactcttctagtttttcaaaatcttatttcactgtgttctagaaggctgaaggacctttcacctcagatatttaacatgatctcagtacctcagttggactgtacggtcatggagaggtagccagtcatcttacagacactggctttggctttgtgccagttgatgatggggtgagtagagactatagctgtccattcttcatttcaccatgggaattaaatagagtgattctgacttcagggctaccaatttagagccttccatggacactaaatttgctttacattaaaaaaaaatttttgcactgatgacttaatactcaagcggcctgtagtgtgttgtaccacttcctctaaaagaaatagcaggagaactaatgagccaataacctaaatgttagttttgcagaatgattcaaccactttagtttccatcatgaatctctaatgaagggtgctgaggctctggggaatatattgtaaataagaattctattttttattgaaataaaggggcttcttcattggaataaagctttcattgaatataatgacattcaggcacttattcatagtacaccattttgagcaaagtttgaggtcattttaacaccactgtaactgcacaataccttagcatgtctttttggttggatgctgaccttttctctcttttccggttgcttcctaaggtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgagtaaaataaaaaatatttaacatttggttaaacacaaggatttgtcttcctttctctcttttaaatggcatctactcacaaaatctgcagcagtatcttttagatttcaggtgtgtataaatgacaactaaagaagaaaaatatttaaatgacctaatgatgtatctcttgatatactagcatttcctcccccaaaattgctgtaaaagctctcacagaaacttaaagacaatgctatctgtaattgtaatatcctcagaaaatttttgttttcttgggttcgtatattctattttgtttaaaaatgtgtaagggctcatttgatgtctggtactaattttactagtcatggatgtattaataccccagcttgatttttacatctgtctttctcagcagctgatgatgtgaataaaatttgtctgttgcattaaaatggtgaccttagaactaatgaactttacacttgaggcactcaaaaggtgttatattattattttagttgtcaaccacagtttgtatgagccttagaagctgctaaaggctgagagagctgtgacatgtctggtatttacagtctccagaagagaggcacagttcatccttttgttttttcagggcactggaatggcccaatacagttaaagccacacctgcctttcaaaccaggtgtattagtccattcttccactactataaaaaataccggagactgggtaatttattataaagaaaagaggttcaattggctcatggttctgtgggctatacaggaagcatgattctggcatctgctcagcttctggggagaccttagaaaacttacaatcacggcagcagacaaaggctgagcaagcacttcatgtggccagaatagggaggaaaagaaagaaagggaggtacttcacacttttaaaccaccagatctcatgagaattctatcaggagactagcactaggtggatggtgttaaagtactgatgagaaaacgtctacatgttccaataacctcccatcaggccccaccaccaaagctggggattacaattggacatgaggtttgggtggggacacagagccaaatcatgtaacttggggtgctgggtaccacagtttccagtatgagctctcatatgagcatccatccagtggctcatgtgaacctcatttgaactagaggacatttacatccttgttcattttataaaaattatctttgatttctcacttttttttttttttttaatcttgaagcagataatgagtgtgcgtcctcagagggtcttgataattgttcattgttttggctttcagatactaagatatgagtttagcaaatgtgattggcaggggtcagagttttcatacacaactagggttgaaatgatacacaaaggggacgtcatgtctgacgtcaagccttgtgcataggacatgatggtttctgattctcaatgcttattctccatgtgttcagtagttaacagataggagaccaatttgtcctagtcttgaagtttccattgtcttgaagtctccattctgcccactgaccagtcctacagaattgggttttaatattaaaaacgtagaaatagaaacttttaaagacagtgccatctttgcagaagatgccaaatagatatgtttgttgcatatttttgtatcaacaatgacaaaaaaattatctttacttgcctttattttgtgttatctgtgaaactgtgccatgttttggcaggcagtagtacattaaaagcttcacaaagaaagtttaaaatctaaatgcagagcggtaaccatgactgaattactcccttggggataaaatgctcttagagtgcctactgaaatcagcattatcatttcaatacatgtcaaatatgagtcatttactagtttaggcaaaatttcttcatgaatctttaaatctttctcttctttcaagaaaaggttaaagtacttatgatttaatgagactgctttatttcataactgtttgactatcaagagaaaacttgtccttttcgatttgtacactcttttatttatttttttgcataagttttaaactattctgcattttatattaaaactacagaactaggcagtcacaaaatgttagaaaaccattcagatctgtcatttaatcatctagcacttattaaatatttgaggggtatgcagcattatgggaatctggatttattcaaatgaaaattaaagagcaattatttactctaaaatggagctctatataaggttcctttatattggacaacagtctgaatatgtttaaggtattatgaaatttataaaaatccatattatagatttttttttgagacagagtttctcccttgttgcccaggctggagtgcaatggcatgatcttggctcactgcaacctccgtctcctgagttcaagagattatcctgcctcagcctcccaagtagctgagattacaggtgcctacaaccacactggctaattttttgtatttttagtagagaaggagtttcaccattgttggccaggctggtctcgaattcctgacctcaggtgatccacctgccttggcctcccaaagtgatggtattacaggcatgagccagagtgcccagcctagattttgaaaaaggaatgtactgattactcaaaagttgttataagaaataatggaggccaggcgcagtggttcatgcctgtaatcccagcattttgggaggtagaagtgaacggatagctcgaaccaggagttcgaggccagcctgggcaacatggcaaaacctcatctctacgaaaaaacaccctaaaaaaattagccaggtgtgatggtgcgtgtctgtagacccagctactcaggaggttggggctaaagtgaaaagatcacctaagcctggaagtcaaggcttcagtgacccatgatcatgccactgcattccagcctgggcgaaagagcaagatcctgtctgaaaaaaaaaaaaaaaaaaaaaaaaagtgacaggaaggacaggagattaggagttgggaaatctgatttaggttatgctactctgtagtcttaagaataaaatttataggaatccatatgatagttgtttaataaggaatgtactaattgcttaaacgttgttataagaagtaatggaagctgggcacagtggctcacacctataccctgcccgccttgacgtctcaaactgagtcatttgactcagttttcctatttacataagaagattgaactagatgaacaaaatgagggccttttgaattcttcataaacaagtaagtggagtgtggagtgtagcacaagtcattaaagtatggcaagctgttgagttgtgtagggttatttaggtagtaagtgacagagccagccccattaaccaatgatcagtcttgtgctttttttctcttctcccatgctgcttggcatttacataaaaacatttttttgctagattttctggacaaaatatagagaaatgtagattgttactattccattgtataactgcaagaacatttccagaaaaaatattttagtataaaatgtaacttactgttgcatgattatataatgcatctaaactccatttaatttggggattagggacttttatcatgctgggcataggacagaacaaatgattaataatcttgtttagtcaagtttcaaactacaaacctgcactttatgtatatgtggattttcacccatcttccaaatggccacaaattgatgaatttatatagtgtgtgtgtttctgtgcatgtgaaaaaataaaacatacaactctattcgtggaatggcccagaaaccagaattttagttcgttgcttatagtgattttttactggttagcttatacctggtggcataaaattaattagcagatctcaacttatgctttatctcagacagttcacttgtatcagctttccatcagtaaaatcagaattctaatttaccaaaatcagaaaaaaaattattttaaataattaaatatctgggggaaaagatgtcaggaaatccagacataccaaaattggaaatcgaatttcctaaacaaacaaatagacaatatgctcaatattgctatggtaatgaatctcacagcttttattccaaaactagcattttaaagtgtcaatctgttggaaaatgattagtgtttaaattaatattcatttatggacttgaatctgacaggattgccaattgaaattttactttggggtttaatatattggctatttcaaattatatcaagctaaaattcattgtgtcattttttatactaaaactagaaaaaatcaattcatagtttttattatcatatagggaacactgatcatattagcaaaatttttaaagcttagttttcatattaaatcagcacatgctgtagttataagatttcctttggttactcttataaaagttttgaaatatgtaaaaaaatttactttagcatttcgttatggattggtaggtaaaacaatatggaaataagtatatgtgtttagtggcatttcatttaaaagtaaaactttagggttttctttgacaatatattttgccttaagcagttccacacattttatagcccaaatagtgtcaaagaatcatcagtatagtcatccttctagtaattatgcagaattgcagtaaaacaattactacgatttgaagctgatgaaatactacagctgtggaaccaagaaatgatttagcattgggcttgttcacattttctatgctattttcagggctccttgatacattgacaattcaagagccatagatgactctagctacaatagtgtgaaaaagagcagttctaatatgatacaatgaagaaaaaaatgcatgggtaaataaagttttaggaatcaatatatgaaggataggagtttcataatcacagttcatgaagtatgctcttttgatttatgtattcaatctaagaaagaaaaactattgatagttctggaggaaaacaaaatgcaatttaaccaacatttgttagaatagataaaccaagtctctcaattaatctctgaactgtatgcccatgtgcacactttataaaggtgtttccatgttcctattgattgagggaacataaaacatccatgtcaccttatggaagcctcctcattcagttcagtaagctttatggcatagaattgtcataggaataccatcccagccccactcccattctaagagaatctcaacccatattatttctttaatatatcattgcatttagctctgactctgtgtgtgtgtgtatgtgtgtgtaagtatgcatgcatatgtgtgctaaatgtttctttgtgcaaagccttctctttatatctagccagctgggttaacagctcaagttagttgaatagttttgggttattcaaaataaattaagatcaatagaatataatgaagtttttcagaacaatcagttacaaattatcatagctgctattaatcattgatttatgtgcactatattaaacatgttacatatttgcagttatacaatgaaatagtgacatgcttgtaacatgtttaatatagtgttaataatagctctgtgccactgacttatattatctccatgacagagattttaaaaaattagccttaggaaatttaaactacctgcctacatttatagtcccaagcttctctgaccttaaactaaaagtaataacttgccatgaacatgggtcactgagcagatctaaataatagtttttaaaattctccaaaccaaaaaaaaaaggcacagaatcccaaaagaactgaaaacatatatttataatgtaaatataattttgtatatttatacatatttgtaatataaatattttcaatgcttcagatatttacatgatttatacaaataattaaagtcaatatattttttaactatacccctcattgatacaagcaatttaaatgtacaacagaatgtaattttgtataaagttctgcgcaatattttcatgttttatggcagttgcgatagactacaatggcttaaagaaagaatatttcccttaagccagcctgatcacctgacccatgccttatagaatcaacccttattacaataaaatacaaagaaggaagcacttcctactttattatggaagaggtaaaaccatccaagtaaaaaagtaattattctctgtacgttttttgcatgtgattttaaaatgcaatatttaagcagaaggcaaggctttaattcttgaccttttagtaaaaaattgtgcaaccctgggaaaactatgtaactcctcaaaatgttaggatacccattacaaattggaaacaaacaaacttggcctatttagcttacaccataaatttgaacatataaagaaaatattgtctactaaaacactttatagcctataacttcctgctatgaaggagcttacagtctcttcagaggataagcaatcaaataattacacaaataaaggcaaaattataattgtggtaagtgctacatgatcacatgaagaatgatttggtcaaaccactgaagtcaagaaaagcttccttgagtaaatgttattgaatatgtgtattagttttctaggcctgtactaaaaaattatcacaaactggtggcttaacacaacagttaattcattgttgaagagttctggaggctagaaagctgaaatcaagttgttagaagggccatgctctttctgaaacctctagaatccttccttgtctcttccagcatctggtgtttgcacagacaccagagtatgtgattgtgctacctcctggggtttgtctgcccacagcaaggccgggaacccagaaaagaaaagaggagtgcccagtgtagccaccacccactgcatgagaaacagagctggcagcaatccttgatgctccttagcttgtagctacatcactccagcctctgtctgcattatcatatggtcctctcctctgatcgtgtgtgtcttctcttcttataaggacatcagttgtactggattaggattcttcctaattcggtaggactcatcttaacaattacatccaaaaagacactacccaaataaggtcagagtcacaggcacatagggttagggcttcagtatgacttttgatgggacacagttcaactgatagtaagatttattcaaaagaatgcataggatccaactgggcaaagagaattgataagaacattccataaatgcatagcaaatagtgtaaatgcccttgtataaaaagaaatatgttacatagactaaaaaaccaaagtggttagagtgtcgctggcaaagtgggacatggtgtgaaatgaggacagaacagtaggaagaggctatgtgttaaagagaatcactggatatgttaagattttttttttaaatggaactctattgaactgttttatgtgaaggacaggagatgagggatgaggataaggaaggaaaacgtatgatatgcacagattattttttcctaaagatcactttggctgcagtgagggagaatggtttgcttgaagacaagtgtgaagggttgttatggtattttcatggaccaagtcagatgtaagtgttacttacttacagcatgaagacaatagtgaatatgcaaatgaatggtcagctttgagaggagtttaagaattaaattaaagggcttgttgatgaaggaatatgtaatatgagggaaagggagttgatgaatcccagctttctggcttatgtaattgcaggtacagtgatttctttttctcaaatagaaatactggaagagaatcagattttggatgtggagcacatatgaattagattccagtttagggtaataattctcaactatagaaattattagcattattgagaaactttaaaaaatattctgatgtccatatccctttatgtcttcattggtctaggtggggcgcaggcattatttctttctttcttccttccctgatggatttaaaaaggtgtaacaaaagaaaatatcagtctaccattgatgagcatttaggttggttccatatctttgctattgtgaacagtgctgcaacgaatatacatgtgcatgcgtctttatgatagaatgactcagattcctttggatatatacgcaggaatggaattgctgggtataatggtagttctgttttttttggtctttgaggaattgtcacactgttttctgtaatggttgaagtaatttacactcccaacatcagcctattaagcattcctttttctctgcaacctcactagcactgttgtttcttgactttttaataacagacattctgactgatgtgagatggtatctttcattgtggttttgattgacattgctctgatgatcagcgatcatatgcttgttggccacatgtatgtcttcttttgaaaagggtctatttatgtcctttgcccactttttaatagggttgtttttttcttgtagatttgttgaagtttgttatagaggccagctatcagacctttgccagatgtatagtttgcaaaacttttctctcactctataggttatctgttcactctgttgatagttcgttttgctgtgcagaagctctttaatttaatttgatcccatttgtcattgcttttggcatctctgtcgtgaaatctttgcctgttcctatttcctatgtccagaatgctattgcctagattgtctttcaggcttttagttttgggttttacgtttaagtctttattccaacttgagttgatttttatatatggtataaggaaggggtccagtttcaatcttctgcatatggctagccagttatcccaacatttattgaatagggagtcctttccccattgcttgtttttgtcagctttctcaaagatcagatggtggtaggtgtgatggccttatttctgggctctctattctttttcttcggtctatgtgtctgtttttgtaccagattcatgctgttttgcttactgtagccctgtagtatagtttgcagtcaagtaatgcaatgcctccacctttgttatttttgtgtaggattctctgtctatttgggctcatttttggttttatatgaatttaaaaagtttttttctagttattccaagaatgtcgttgtttgtttgatagaaatagcactgaatctgtaaattgctttgggcaatatggccattttaacgatattggtccttcctattcatgagcatggaatgtcacacaaaccaatgatatctgtttgtgtcatctctgatttatttgagcagtgctttgcatttctcattgtacagatctttcccctccctggttaactgtattcctggtattttattctttttgtggcgattgtttcacctgcttctaatcaaatctatttagtagctgttattaaactgtgtagccattagtatacagtagtactccattacccttggctttgctttctgttgtttgtcacccacagtcaaccacagtctgaaaatatcaaatggaaaatttcagaagtaaacaattcataagttttaaattgggtgctgttctgtgtagtgtgatgacatgtgaggtggtcaccatacctcctgcctgggaggtgaagcatccctttgtccagcagcttctccatattgtctatgctcctagcccttcagtcacatagtagctctcttagtaatcagatcagctgttgctgtatcacagttgtaacttgtgttcaaggaaactgtatttcacttcttaatggccccaaagtgcaataatagtaatgctggcaatttggctatgccaagaagccataaagtccctcttttaagtgaaaaggtaaacactctcaacttaacaaatgaaagagaaaagatcatatgctgaaattactaagaacttcagtgtaagaatgtatcttctgtccatgaaattctgaacaatgtattgttataattattctattttgatagttattgttaatctcttactgggcctaatttataaaaattaaactttatcttgggtatgtatgtataggaaaaaacatagcatatattgggttcagtaatatccacggtttcaggcattcactgggagtcttgcaacatatcctcaatggataaagggggactactgtatgcgcaatatatgtatacgcttaaaaagagttttgtttagctagtgtgtgtaagaagattatcacaagtcacactgtagtgtttgccttttgccagtctgaatgttatcatcagtctaatattttatagcaaagatttaagttcattgaaaacttccctatggaaacacttccaatcaagacctacagcaagccatgaataaattaacatttaaacatgaaaactgatatttgaagaagaattagcaattaataatttctgctagaaaatggtggtttctcagccaatagctataaattgtataatatatgtaaaaggaaatatatacaaatatcatatgggacatatatcacatatactactaaaattgaaaattgctataaatagaagactatgttccaatgtccactgatttttttttttttaacaatctctagtcttgaaaatgccactatggtaattctgtcaaatttgtaatggttgggatttgatggtagtgcttttgaaacctgtattatctaatggaattgtcatttatattatatcattttcacctaaaagccaaatacaataagacttaaattatttttgctttttttgtggatagtcatttttgtgcccaaagggctaactgatgccttcagttatacatgaacaattcgcactaacgtcaggaagaacagtgtgcatataacctagggcagaatttggtctatggaatgtatcactcagtagtggaatggagattatgactttatttaaacatggacttgagtagttttatttttccttactgtttcccttggcatttctttctctaaagtgcaacattcaaaagtattctatgcagctgtagtgtcctggatgcataataagggcatatgttcaaggcaagtttaaatatccacataagccaaagacagagtaattaacattaaaaaaattaagacaacttttccaagaatgaaaagctttaatagattagctaattttagaattatttaacaacaactgtgaaaaattattagtatttacaaatatgtatatataaatatatgtaatgtcttatgttagacagcaatttcattctgctctctaatgattacatgacatacttctgaaaaaagtcaaacagtgtgttctagaaggacaaagaaataattggttcagttttgcttatacttagtgttcaattgttatcaacctggggtgggaggaagggaaagaaagagggaaggacagaagagagcaagaaaagaaggaaggaggagaggaaggagagatggaagtcatgtgacatagctagggatttggggcaaaattcaagacccatgttttccttgatggaaagccaaggaacctgagaaggagagtcagcccatgccaatttcactgtggtagaggtgaccaagaaagtttacattatggatgtatagtaggtaattttaggttgtttttgtctgggatataaacccattgtgttattccagttatttggccaaaatgttccatgcaaccattttggagtgctagcactttagggaatttataaaaaggggtggtgttcagtgtctgggttgaatacaaggtaggtagaaaaggacaatcaaaggaattagctgcaaatgagatgaaatctatgggaacatatattgagaaaactagtgaccattataatttaatcctctgaaatacctgcaacaatctgagaacaaggtaggtggcaagatgcatttataaatattaaagaaacacaagaccccatacactttgaaaactggggagtaccgaacttggagaggtctagtataggtagtgcttgttggtttgcatatttttaaaaccactttattgaggtctgattgacatagaaaagtctgtccatgttgcatgtatgcaacttaatgagtctaaagataaatatatgcccatgaaagtatcaccataatctgtggcataaacatatccacctatttgtttattcttaattaaactttttcctgagataattgtaggttcacaggcacttgtgagaaataatacagaagtcccatgtaccctttactcatttgttctcatcagtaacatcttttataactatggtacaatattacgaccaggatatggacattaatataaccaatattattcacatttcccatttttcatatattcctatgtgtatatgtttagatccatatgattttattaaaattttatccaccacagccgagttgcagaaaagttccatccctacaaggacacctcaagctgcctttttataaccatgcccactgtctcccttcccctactgctgccacaggtgtccctaacttctggcaaccactcacttgtactctatttctaaaatttggtcttttcaaaatgttgtatacatgacatcacacaatatgtactcttttgggattgtttctttcttttttactcaacataattccgtggggattcattcaagttgttaagggcattgatagtccaccttattgcagcatagcattccacggtatgtgggtaccatggtttgtttaacccttcacccattgaaggacatctaggttaattctagttttgggttgtatcaaacacagttaaagcattcgtgtggatgtttttgttaacatacatattcgtttctctggaataaatgctcaagagtgcaatagcgtatggcagttgcatgtgtgtgttttaagaaactcatttccagagtggctgttccattttagaatcccaccagtgatgtatgagtgctccagattgtgcacatcctttgtagcatttaaaataaaggctacatttattttactatttaaaataacattttagccattctgatagataatatatcactgtggttttattttgcatttctttaatgactaatggtgttcagcatattttcatgtgcttatttaccattcatatgtccaattcggtgatgtctccccatgtcttctgcccattttctaatttgattgcttatttgtagcttgctgtttttattctttttacagggttttgctgagattgattaggtccaatttatcaatctttcctcttatgtattgtgttttccatgtcaagtctatgaagtcttgcctaaccctaaatcctgagtattttttctaaaagattttttttattttatattgttaaatttaagtatgtgtttcaggccaggcatggtggctcatgcctgtaatccccacacgtcaggatgctgaggtgggtgaattgcttgagcccaggacttcgagaccagcctgggcaccttgtctttacgaaaaattggctgggcatggtgctgtgtgtctgtagttccacctatgggggaggctgaggtgggagaatcagttgagctctggagtttgagaccagcctgggcaccttttctttacaaaacattggctgggcatggtgctgtgtgtctgtagttccacctatgggggaggctgaggtgggagaatcagttgagctctggagtttgagaccagcctgggcaacttggtgaaacctcgtctctactaaaaatacaaaaacaattagccaggcatagtggagtgcacctgtagtcccaactgctcaggagctgaggaaggaagatcacctgacctcaggaagttgaggctgctgtgagcagagatcatgccactgcactccagcctgggcaacagagtgagaccctgtcttaaaaaaaaaaaaaaaaaaaaagcctatgtttcactttgagttaatatttttttaaggtgtgagatttggttttgagcagtggatgtccaaatagcccttagttgaaaaggctatatccttccttcactgaattgctttggcacatttgtcaaaaattagtagaagatatttatgttgatttatttcagaattctatgtatatccttccaccaattccacatgttcttgagtactgtgagctataatatctagtagagcgactccttctactttatcctgctatttcaattacaaaaaataataaaccttttagggcctatgattttccatataaatttcacaataagcttgttgatgttttcaaaatatcttgtttagattttgataggaattgcattatatctatagatggatttggagtgatttgaaatcttttactatattgagtcctctaatatataaacatggtgtaagtatcaccatttaggtcctcttttattggcattttgtaatttttagcacatacattgtattagtctgttctcaccctgctataaagatactaccagagactgggtaatttataaagaaaagaggtttaattgacttggtttcacatggctggggaggcctcaggaaacttacaatcatggtggaaggtgaagggaaagcaaggaccttcctcacgtggcgtcaggagagagaagagtgaggtgtgaaggggaaagatccccttattaagccatcagatctcgtgagaactcactcactatcatgagaacagcatgtgggaaactgcccccatgatctaatcacctcccgccaggtgcctccctagacacgtggggattatggggattatacagttcaagatgatatttgggtggagacacagccaaactatatcatacatcctgcacctgttttgttgagcttacccataaagtgtttcattttctttttggtgattgtaattggttttgtgttttaaattttggcttctgcatgattattgttggtatatagcaatgttatgaattttctagggtgatcttgtatttcaaaactttgctgaactcacatttatagtagttctggaaattctttatttgttggaattttctacatagacaatcatgacatctgaatttggagcagtttttttaatctttccaatatgtagtttttatttctttttccttactgcagtgactagaatttttagtagtatgttgaataagaaaggtaagagcagagattcttgctcttcttgttcctaatcttaggaagaaaaagagttcaactttcaccattaagtatgatgttagctgtagattgtttgggtaagtgttctttatcaaattaatgaagttcctctctattcctaatttcttggagttttgagtattaaatattgtcacaaggcattttctgattcaattgatatgattatatgatttttcttctttagtctattaatgtggttgattacactgattgattttcaattgttgaaccaaccttacatacctgaaataaatcctacttggtcatagtatacaattatagtatatgtagtatacaattccttttatatagtgctgaattgatttgctcttctttctctagtttcttgaggtagaaacttaatgttttaagatccttcctcttttctcatataagtattagatttagcttagtgttgtaatttaatgtgtaatttaatttagtatttaatttagtttagtgcaataaatttccccttccacgctgctttagcagcatctgacatattttattatgttgtatgtttgactcttggacaaaatgagggcttggggtattgactcccgatggagttaaaaatttgcatttaacttttgaccaccccaaaatgtaactactaatagcctactgttgaatggaagccttaccaataagataaatggtccattaacacatattttgcatgttatatgttttacgtgctgtattcttataattaaatagagaaagaaaacattgttaagataattataaggaagataaatatatatttactattcattaagtgggagtggatcattatataagtcttcatgctcattattttcacattgagtaggctgaggaggaggagaaagaagggttggccttgttgtctcaggtggcaaaggcagaagaaaatttgtatataagtgaatctgtgtagttcaaacctgtgttgttcaaaggtcagctatattttcatgtgcattcagttctatgtttttgaaatttcctttgaggttttcaaaattttcttttacaactttctttttgactcatgggttatatagagatgtattgtttagtttcaaataaattggagattttaaatattataattctgttattgatttcaaatttgaatcattttcaatcagagaacacattcagtgtgaattcagttctttaacatttgttcaggattttttaacaggccagaatgtagtctatcttggtgaaagtttcacaagtatttgaaattaatgtgtatagtttgttttgtgtttacacacgcacacaaacacagatgcatacacatataaatcttctgttatctttttatttctatttaaagaacttcttttagtcattatttaagagtaggtgtgaagaaaaccaattctcttataaatagaactaagtacatctactttgtatacttttcttgagtgattctatattgtaatgatgtcctttttactagttctatcaattgctgagagtttgctgttgacgtccctgatttaattgtgggcttatctatttctcctttcagctgtatcagtcttgcttcatgcatgttaaagttctgttgttaggtgcatacatgtttaggatcattaggtctttctagtggagatatcattttatcattatgtaatgtccctcttaacctctagatatttggtttgttctgaaatctatgctatttgatagttactagttattccttttttcttttgattaatgtttgcagatatatttttctgattactaatttcaactgacctgtgttgatgtccatgaagtgaatgttgtacagatagcatattttttggatacttttttaaaaattaagtttatattctaatacactctgctaatctctgtcatttatttgtatatttagaccatttacatctgagattcttactgatatgctagccttatgtgtgcaattttattttttctatttcttgtctgttgtgggtctctgcatttctcttttctgaccttgctgtaggttacgtgaacacattttaggattctatcttggtgttttaacagcattttgggtatatcttttttgtatagtgtttttagtggctctaggtattaaagtatatgtaagtcacttatctactgacatggacatattactacttccattaaagtgtacttttatttccacttaggtcctttactcattctaccttttcagtataattgtcttaagtgtttcccctacatacagtgagcatcacattacactgagttgtaatttttgcttcaaccgtgaaatattatctagcaaactaataagagggaaagtctaacttatttccccctaattttattcattctgatattcttattttctttataagttctgaagcttttattatcattttgtttctatttaaagaacttcctttagtcatcctttaagaatgggtttgatgaaaacaaatactcttatttttcactcatctgagagtgtcttgatttttccttcattccgaaaggatatttttgctggatataaaatttatgattgacagttaattgctttcattacttgataaatgttgtgccactccttctggcttctaatttttcagatgagaaatctgttgtcatttgaactggtatttacttataagttttacatcattcctctggctgctttcaaggttttctctttgcttgttttgtatttagcagtttaatagtgaaagccctagcatgagtttccttggttttatcctattgtatgagatttgctcagcttcttgcatgtgtttgttaatgtcttttgccatattttcagtattttcagacattctttcttgaatacattttcactgccattctctcctcttattctaggattccagttatacaaatgttaactcttttgtttttaactcactggttcttgaagctctcttcaagtttttttttttccttttaatctctcttttcttatttgttcaaattaggtaaattcttttgatttccttcaggttcaggaatcctgtcatcttcctgttacccttgaacccatatagcaagtttgagtttgtttcaatggttgtatgtttcagttatttagtttccgtttggatcttttatatatatatatatatatataacttctatttctatgctggggtttctctcattttttttcttgcttgaaagaattcacaattgcttgttgatgcatttttattgtatctggtttaaaatccttgcctgataattccaacatatgattcatatcactgatggcatctgttgatcttcttctttcattcaagttgttattttgatggttcttagtatgacaagtgatttttattatatcctggatgttttgggtatcgtagtatgagactctggatccaaattcatcttctttttttattcagaagctgtccttacattgaggtgtgcacagaggccaggtgggtgtgtatgttcattcatcaccccgttgtcactgccaacatcatccagcagaagtggagcactgactcacactgcagcagatgggtagggtgaaacttcagcttccctgttgaccccttcccagtgaaagcgggccgcctattgctgctgccttgttgcccctcatggtgacatattcctaactccccactgagccacggaagggaaaaattcattgcttgttcacactactttgttgctgcagggtaggggtggaagctgagcttcctgctggtctctgtgacaccaggggaggtggggaatggagtgtcaagtaaccctcctcctatcaccttattctgcctcattgatgccaggtgtgagagaaggttctgcttctctccagaactctcccagttcttgtgaactgggtccaattcacaagaaagggaaaaaggatgtagagtattgattggccctaacacctagcacacagtctcactaataccactgggagtaggggctcagctcccctctaggccctgctcacttagtgagggtggggtgggaacagaatggagactaaccctgacacacaccacctcatgtggtcttgtgctgtgaagagagtggagaggttcattccctccttggtcccactgacaccagaggttggagtaaagtaaagtgctgatgagccctgactctcgtgtccttgtttagtcttgttaatattgggtggatgttgagcttcagctcctgactggggccctgccagagccggggggaatgtaatgtgctgactagtcctgccttgcaccacttcactaagtcttgctgctaccaggtaggggtggtggagatggtttagctacttgctgggctgaggtgacactaacttagtaaagagttggagcatggctgactcctttcagacaggggatgaaagatcagccctctgctcactctgccaatactatttagaaaagagaatcagagtggcacaacttccactgagcagaggacagaaaataagctccttatttggtctcatcaaaaccacccctacctacagttagacagctgcctgtttcaacaagtggagaatggaagatcagctctctgtttggtttattggaaccaccaggcaaggggaattggaacactgactgcttctgccagtgggaatagaaggttagctgcctcttggccctgtcaacaccactgtgaaagggaatcaaaaactactgcttacttctgttgggtgagagggtggggtgaaagattagctccctgatgagctcggctgctggaactatgaatgtgtgtgagtgtgtgtggggagagagtgtgtgtgtgtgtatgggtgtgcttgtgtgtgtgtgtttggtttttccattggagtttggctaaagtatgacaggtactttttgctaaaaaggttttctcttgtaggccaacattttcctgatcttctgtctaggaaaataagcctttccttggagcttattttgtctgtgcctgttggtggttctacgttagatgtttctggatattaaaacaacaacgaaaactagggaatttgccatgttgttcctcaagtcctcagattcctaattttttttcttctacctacttcgcaaagtcatcttacacttatttgttttgttatgttcagggctttttaattatagaaagagaactgggaggaataaggctgctccatctctgtcaggatcagaagtcatgtagtgttataaaaaggactttgtctaccattttaaaatagctgttggctgtaagctccttattgtatttaaagtatattggctaaaattgtgggaggtaaggaaaactctttgtaaagtgaactgacatggtgaaaagagagagaagatatgcttgtcaaatattgcgaagtctattcagatcaagctagacatggtctgtattagtcagggttctccagaagaaaagaaccaataggaggtgcatgtctgtgtgtgtatgaaaaggaatgtattagggagaatttgctcacatcattataaaggcaatgtcccacgacaggctgtcagcaagctatagaatgatagaagccactagtatgtctcccaaggaaggtgatactatgtctcagtccaagtcccaaagcttcaaaaccagggaagctgacagtgcatcccatagtctaaggctgaaagcctgagaacccccagatcccccagagaccactgctgcaagtttcagggtccaaaggctaaagaacctagagtctgatgtctaaaggcaggaggaagaaagggcattctgcactggaagagaaagagagaggcagctcacaaagcaagaaaagcctgcaagctgaatatcccccttcttctgtctgctttactgtagacacacctgcagctgattggatggtacccacctacattgagggtaggtctttctctcagtccactggcttatatgtcaatctcctctggaaacaccgcaatagatacatcaagaaacagtgctttaccagccatctaggtatccctcaatccagtcaaattaatattaaccatcacatggcctattcacaatttaaaaatgtagcataaattgcagcagtggtcaagtgtattggcaagttgtaaagtgcctataagaaacctatacacgagcatttgcagattcccttaacacttttcagcaaatattttgttacaattgaaattaaaaggcagtttgaaattgttcctctactaaatatcacactggatatgaataaaataactagatagactaacaaggtacatactttattgcctgtgattattgcaactaccactcctggtggagagccattcttctcaggtgtgcaagtggaagattaattctcaatcaggaatatagatttgatacaaggaaagcatttcacttggcattagtgtgtcaacatttcagctaatttgcctaaccacaaatacttcagggggaagagaaattgctagtgctttatattaaacattggatggagctggcggagataatacaatttgtactttttttacatagtttcaacgaattttggcagatatgtctttttgaggcaactttagatgttgaaaagctgcttgtggatattcaagacttgtctttttttcatgttacaatgaccatcaccatagtttgtatctgattttttttgtgtgaattgaggaatgtggagtcataatgcaaaagtcattgccataattctttgcagatcttatgactggaaattcttgtgtatgtagtttgatattcatttgtaacacatgtaactggttcgtgtaatgattaaaataataagtaatgcttgatcatggttaaaataaataccaaggataaattcttctattaattagtgtaagcttatcctaattaacatctttaattatgggctgttgttaatttttgtcgcaacctattagatatactgtcctaaatcattaacactagtgtaactgagcataaactctaggtgactcacggctacagtggaagcgcccatggaaaatatatatttctaagtacacagtttagataatttcaagcagaatcagaaaattcttgatgaattctaaatttagtataaacagaaatgtattaggtttggttattgagccaagcttcaaacattgaatatcagaattgtgtccatttgcaatgagtaagcatttgattcaagatttttttttgtactcagactcatttttgtatatctttctgtttaagtcatattgtatttactgcgattacagattttttacatatttcttaaactggttctatgttatgccattatataacaggtgataaggaatgtactgtcactgccccttgacaatgaaaaggggacatctctactagtgtatgtgtatgtagctgtggaggagttgaaacagtgtaagtgaaatgcctagaaattgtcctgagttttgattttgtttgtgcttacatttttattagtatatgtactttcttgaatagataattgatttggggcaatatttctcaatcttggcactactgacattttggactggataattattggttgtgcctggctttcctgtgcattgtaggatgttcagaagaatctctggtctctacccactagatgccagtagcaaacctgccacctctctgcctacttccgtcctgtcttgcaatagtcaaaaatgtctgcagacattgccaagtgtcccctaaggggcatgagccttggtggagagaaacttctttacagtctcatccttggcgatgtcatttccttataatttgcgtagttaaacatttttgttttgaggagcataagttgtgataccatacctgtacagaagaggcttggatttaaggttaaccacatttaactgagagaattttatcaaagcatgaaataagaaaaataggggcaaaaaatgaaattctaaaatggcttatgcaatttctaagggtagctaataagaattctgaattggtgacattgtttttaaaaaaagtaaagcattaaaagaatttcaaagataaaatatattttttggagtgtgaacactgtaattaaggagacccaataatgttaagttacttaaaggatgtatttttacttaaagtaggatacaagttggagaaattaacattcggttgattgttaaatattttgattcaaagaaagaacatagaattgtcagcctcaaaaaatatgcttaagatagaaaaataattttggttgcatgaaaagaaaaagattttagtaaattgttgacttgaaaaggggaactatttgacagaagtctcaacagtgttttggagtggcatagtgattggggggtgacatcagatgattagagttaaaaacgactggaccggctgggcgcggtggctcacgcctgtaatcccagcactttgggaggccgaggcggctggatcacaaggtcaggagagcgagaccatcctggctaacacggtgaaaacccgtctctactaaaaatacaaaaaattagccgggcgtggtggcgggcgcctgtagtcccagctacttgggaggctgaggcaggagaatggcgtgaacccgggaggcggagcttgcagtgagcggagatcgcgccactgcactccagcctgggcgacagagcgagactctgtctcaaaaaaaaaaaaaaaagactggaccagttattaggccttaagttgatgtaaactatatgacaaattgacaatttagagacattgtggggacatttctatgaaacgtctgtttattattcattcctgtgatgattttgaaagggcaaataaaatcataatcacatattgtataatgctttttgtctttcaaatacatatacattaaaaatgacttatataaagcaaaatgtacctttttgtgcacaattctattggtttttgtggatgtatactgttgcataaccaccatccaaccaatacacagaagagttctataacttcagaatattcctttgtgctactcttttatagtcattcccatcttcccatccccaccctctattgacccgtaaactgttttctgaataaatatctgggaaaaggattgctgtgccacatggtaggtgtatgtttaaagtttctcagaagttgacagactttttccacggtggctgtaccattttgccttctcaccagcaaaatgtcagattacagttgttttgcatcctggccagcacttggtatggccacttcatttatttatttagctcttcttctgataggtgtttagtggtatctcattatggttttaatttacacttctctaatgattgatgattttccccggtgactgatgatgattgaggatcttttcaggtgcttatttgcctcccatgtgtgtatcctctttagtgaaatgtttgttcaaatcttcccatttcaaaaaatgttggcccttttcttattatgaaatttctatggctctttatgtcttgtgcatagaagtcctctgtcaaacagatgtctgttttgcaaatattttcctgatttgtagcttgtcttctcaatattttaacagtgtcatttatagatcagaagtttccaattcttcaggtctggctcccctccataatctgtttgctttgattcacttttcagcatcctcatgtagttgctttttgtgtttggtctgagattttacttgtgattggcagggagagataggctgaacgtgactgagtggagtatagcatgagaagacttgcataatattttttttaattttcagtgttttgcaaacattatttttgatccattaataatgttaatgattgccattttatatacgagaaaataaaaaaatcaagagtcataagagtttaagttcataaataataaaaagccacatggaaataaccagtgatctaaatcacctggaacaactaaaaccttaaggtattatatcctagtttgtgtgttccgaccacaagcccctagaatgcaaattacttatgtaccttatttaattatgtttgctttacgtaattttagtactttaggaacttccttgattaaatttcaattcatacatttgctgaaaaataactaattttaaaactaagtaaggttattaagtaacttttttccatctggaggagaattgtttttgttccagattctttactgacacaatagtagcacactcgaataagtgcatagtatgcttcatggaagatcatgtgtaaaagccaggcttagtcaatgtttcttctgataatacatgtgaaaagttgaaaagaacctttatggtcattttcctagtaagcaagtcaattccttttgcttaaagcattttaacttcattaatgtaaaagacaatagatatctactatgtatacaacactttttaagagatcttgaggttacagaagatagtaaagccatggtgtctatccttaagaagctatacataataagaaagaaagaaatctcactgtgatattgagtatacatttttggaaagtaatttttgaataaaatcagatgttttaaaaaatcgtaaaaggttttgaatcaacattttcaaatatttagaaaataaatgagaaaaaagacagacccaaccaattccttccagtaattttgctctgatattaatgtaattcccttcagcttttatgtgcatattatatatgttattaaccatagtacatctttaaaacatatataattttgtctgctcacttttttttaaaaaaacagcattgtatcacagtttattttcatgtaccttcatagttcaaggtacaagggaagtaacagagattccctgagagaagacaatggatgttcctaagaaagacctagtgtgagagttcagggaactgctacactttggattttttttttttttttttttttttttgagacggagtcttgctctgtcatccaggctggagtgcagtggcacgatctcagctcactgcaagctctgcctcttggggtcatgccattctcctgcctcagcctcccgggactacaggcgcctgccaccatgcccggctaatttgttttgtatttttagtagagacagggtttcaccgtgttagtcaggatggtcgggatttcctgaccttgtgatccacctgcctcagcttcccaaagtgctgggattacaggtgtgagccaccacacctggccaggattggttttttaaaataatgtagaatgttttgtatttgtccttgcatcatgtaaagatttatccttaaaagtgcaatttgtctttggactataaactctgcgagggacaggacagtacttacatagcatgttaaaaattcaagtatcaatctacccatttaggtctattggctctttactgagtccagggttttatttacatgtatcactgaatgaatggccttaagaaggtacagatgagactactgaggcatagagagatttaacagaggcaagcagagcatcacaagcagtttggaactcaacacatgtttcttgtttgaaaatatgcacagacaaaagagggatggatagaaagttggttcaatataggattaagacctggaacaaaagcacatgggcaccagcagaatctacttgagaggtcacagcgcccaaggggaaacaaccctaggcaagtcacttaacctcactcaccttagttctcttgttggtaaaatgcagagtttatgcaaactcaatacatgtcaagaaatatctgcaaggcattgtttaaaattgaccctctggatttttttcatgcatgcctggttattatttattaagatgtactaggggcaagtctcaaatggaagaaaaaataaaaggcacatctgcaaagtgaagaagtggggttaagcgcaatgcaacagaaactcttatactaatccaggaggactttacctgtcaatcaaatctatattcattttttttaaagattaataatggtttgttaactgagtaagctggcagatggtaaagtaatgtgatgagatcttggggcatctatgaccagttgatgactgactgaccaatttcaaaagatgctatgaaggatcataaagtttagttccatgtggattttgatgatagttgcatctatatttaaagccttctgtcactggaagcactcttggtgttgtcagactgtctattggactggatgagctgcaacttctcgcaattgaatgtcaataagaccaaagcaattttggttgattcatagcaccagcttaagcatattcacttgcacagattacatttgacagatagttaccttcagctgaactctgtggttagaggcttgggcgtattcttgacagtgagcttagagttgatgtctaatgtttatttcatatcctgtttttaccttccctaatattgcatgtgtaaatctatatttaaatatattcacagctgatgttcttgtcggtccacttgttatctctggacagaatgctgtaatgattcaatttaattattttaataaaaataacttgcacccctccagttttaatttcaataaatctgacgagtaatgattaattttaaggagtcttattgatgagcaattgcaacactataatgcaggaaaatgcccaagtggtgggagcatgcttacatctatagtaaacttaaaaccttcaaaatttggtgtgtgattatgaacaccgaggaaatatatccacatttatttaccaaattattattcctgtatcttttttaagttatttaggtccatcagttatcttcaaagtttaggtttgaaactatccatttcaagaatattagccttttaagatgattataatttaaataacatattctaaaatgttttaattgaacagtagaatgcatgtaacccaaaacattataaaatttaaaaagtcacggccatttttgaatatttagattgggaaaacacttaagatgtggttttatgttcaagaagaggtgcaattatggtatggattcattcatcattatggtattgtattgtcaacttttcagttatgttcaatttttaagatgctgggtgggaaatttaagggacatatagatctaataatctgagcctaaatctcctgctctatacaaataactctgcaaagctttggaatccctttatttgactaggtgaatggcagttttgtttgcatcagcctaaacctagcttggaaatcatgattttaaagcaaacacgttttcctcacacatttccatatttcctagaatctatggttttaagatatcaaacaattcaaattatgtagttatacatttcacacaggacaaaaactcatgctgaagtaggtaaaatatttttcaaaattattttctctacatttactggcatactttctctttcttactgtcttttaaaactgacagtcagttttttttatttttctcttttactgacagctagtaaatgtactgacagttcagaagcaagatgtaaatgtaagtcactattattttgttcacctgatacctgagcattagtagaaatgcatggctatattttaaaataaaaactagattatttccaatggttctgaagggaagatgtatagaaaaactgtcctctgtaaataaaaatgtgtttgaggcaagattgcattacatttagaaatagcatactttcctcattaggatgtgattggtatttgtactgaagaaaatgggctaattatttaagtaagatgtatatttactttctgtttcattagctgtaaatctttatagcatataaatctcctttagaaattaatgggaagtatataagtgagggaaagaaagcaggttatgaagttaataaataccatgttaaaaattagtttctacttaaatataaagttcaagattaaaaattaaaaattgttttattttaattagaaaaatcttgcttagttaatttctctggaagaaatgctatataagcagttaaatgtggagaattatattctattgataaaagtatgttgggccagactgaaccaacaacatcatagaaggactgattccttacttcctttaaaaagtgatctgtcatttgtctacattataaataacagctgagttttaaaacacaaggagatttttaaaaagtggcagcatttatttatttactgcttagacagtattcacagtattttatttcatccttaagactctttttttgttttgctcccacattattgttacacatatgggaattggtaaagtgggaaaacttagcatttatagatttttatactgaagcatgcgatgataaagtagtcactttcatccaagaaccttttcctcttttcacttacactagctcttccagaaatggcccctttagtgcctttaatggttttattctccttctgtcactatttttaatattcttattcttatactgccatcatatataactttgtgaaaatttgtcatataaggttaaaattgatttgcctttaaatacagtagtttccattttctgttaactgtttgaagaacacctattgagaggcaaggaaagacctgcgggataagttacaaaaggcaagaattcctcacagaaaaagcagcaggagcttccttgtcaagagcttcagcaagtagtgtcagcagcttagaagttgctattggactgctgagtgttatgcagataaattgtggctctagcttgtcctccgatgtcattctttgatttttctctgttaacactgcatttgcatttgggtctcactgagaacaaggaccagtgcaaatgccttatggcatgtgtagaaagctgcttttatgttaaaagtgatatgttttcttgttcactgtgttcacaacaaaaattcatcttccgagtcttggaattcccttatgtatttgtaattttccttccaagtcataatattcatatacaaagagtggaaatttttctttaaaaaaacctaccaaacaacaaaaacagtaaagttagttggttactagcagcaacaactgaaaagcagcatcaccaaaacatatgcaattcatgggtttccagcaaaagaggaaatctggaaagagaagatccttaagtattgctttaaagtgagcactgaaggacagccgttaaaacaatcccaatttttagaaaaggtattattccctgacatttacttgttttattcccttctcaatctgaagacacattttggacagatgctcttgtcttacatgaacattcaattcatttgagaaaataatggttatacttaaactcgtgaagtgaaatgtatggaagtctgttgctttataactttaaatagccatgtaacttgttcatggcagaatatagtcaagtcctgggcaaggactttttttctcttctccaataatgctattcaaggggaagctagttattgtgtgacacatgcttgattctcaggaggtttggacaaaagagagggttagaaggtcaggagagcctgacgctattcaactagatatttgagtagaattcccacaccagaattttgcctcatacctaattcagacagtgtaataatgggggaagggcagagagagggagggcagatggaggtgtcctttcaggttaaatgttaaaataagggtcttcatttctgtctctggtggcacagagcattaaaaaccctgtgacacattttggaagtgttgctataaaatagattttaacgtttgaggatctataaagggtattattgagtacttaatagattctgtgtttgcctactgaaatcactacaccgccgatatatacctcattaatttgtaaagcagtttggcccaacttgagacaatgtactgtattaaagcaaagtctatatcccaaattttcatggctaataattacaaaacgttcagcatctgaagaaaattatctaaatgtgacaatattggtcttggatagtttaacttgcgtgaaatatttcacacagaaacatttgatctatattgaagagttgtttcttttttcatcagatcagctatatcacagtaaattgtggaaatagaaaatggaaactaaattgttgaaaatgcatctgatagtttgtttttattgccaaaatgtcattgtccttgaggtccatcactttgtagcttagtaaaaacagatttaggcattgcaagtgagaagtcattgactgttttccttgtaaccaatttatttatcaagttggtaagtttcagaagtatttccagtgttcagcctatttcttcacttttctattttccaaattatatcctattacttcaaagatgtataaagttcacacattctggattctttatctcttttattgttttctgcttcatacaaagtaattaaattatgttcttgaagtaattcctcctatcttacttaaaatcaccttcatgatctgtcaagagttttcaagttgttctgtgataaagttcttagagtttgagaagctaaatggtggagttggtgcttaagctcttcactgaaagctgcaagagtataaacgaagtcagaaattactattattattatttttttctcattgagacggagtctcactctgtcgcccaggctggattgcagtggcgtgatctcagctcacggcaagctccgcctcccgggttcgctccattatcctgcctcagcctcccgagtggctgggactacaggtgcccgtcaccacgccaggctaattttttgtatttttagtagagacggggtttcactgtgttagccaggatggtctcgatctcctgaccttgtgatctgcctacctcagcctcccaaagtcccaaagtgctgagattacaggcatgagacaccacacccagcatatatatatatatatatatatatagttttttggtttttgttttttgtttgtttgtttgtttgtttgtttgtttgtttttttgagacgagtctcgctctgtcgcccaggctggagtgcagtggcaggatctcggctcactgcaagctctgcctcccgggttcatgcctcagcctcccgagtagcttggactacaggcgcccgccaccacgaccagcaaattttttgtatttttagtagagatggggtttcaccgtgttagccaggatggtctcaatctcctgaccttgtgatccgcctgccttagcctcccaaagtgctgggattacaggcatgagccactgcacccggcctgaaatgactattctttttaataacttctatttattgttttgtgttattcataattgttgtgcaatttaatttatttcactagtagaacactatgtacaggactgtactgtgtggaggttttagaagtgacaaaaccagttaactaggctcttggtccaaaggaatttagtgaaagagataagacataaacactaatgactgtaacatttatggaataataaataggagctgctgaaagttgtgatttcttctcattatgatagtgcttcttggattataaaaaatttaacctagaacatgaggtttcaagaggcagagatggggagagaagaattccaggtttgggactaggatgtagaaaggcagaaaggtgaaaatattcttgtgatgatggcaaacagtgactggtcaagtttgccaagagtaggttttatgcaagagcgtagtaagatgaaaccctgaaggaattttactgtcagatgatagaaaccggaataaagctgaggatacagttcaataatcaaagggaaccaaatgaaagttttgagcaaagaagggatcttattaaaacagccttttattatttcttttaagctagaggtagcttggcattatctgtgccagctcagagtgaccttcaccccaaaattctagttggattatggagcagttaatcttacaggctctaataattctgtcaccctttgttgtcattctatatctgtgtcccttcagttatgtgtcttctcccatattctcataccattatttctctgtctttcatttctttactttcatcatccacatcaggacaatgtttttattctatagtagtttgtaaacatgtcacattctttagactttcaagctctttgtcaacagtttttcaaagtccttgccttacataaacactaattctttccctttagggacccctttcctggcccttccaagcaaagggtgctcattcatccactcctcatgcacctcattgctgggagcaagtagagatgtagggattgctttcttctttttcttttacctcatattggaaagagatgtttcctttaaagctcatgttaagttgttgtgtacctttcttcaatttttgcatcaatttttgcaaaccttgcatcaatttttgcagctgctgacaccttggataccccagccacctgcctgccagatacaatgaaaaatttcacctctgactcacagtgtttctctgcatcattatcagcttttggttaatgaccatgaagcttcactttttcacctcttgaaaacttttggctacagaatgaagttaagcgcctaggtgcttatattgtctttgagtctgttgggttccttctaggttcagtttcttcacttctagcctagcccacaaggaaaatatctttagtagtcttttaaccattttcttttatttcattttttttcattctgttgccaccagacacctattctcaaatcattcacctgactgccttcttaattcctgtgtatagattgcagaatattactgaaaaaaaacaggtgtgtggattgaggccactaaaaattaatgatttccaactagagatggacccttagtgcagccttagggtaaatttcagaggtgcagctgattcaaagggtgtgcacaatttcaggggtatattgacctactgtcttcagaaaatgtttgactagtgcagactcctaccgaaagagaatcagagtgcctattcctcaaattattgttaatataaggaattatcttttctcatttttttctaattttatgggcaaaatagtatgagtgtattcttatttcatttagcatttcttcccctacctcgtacttatcttaccttacataggcttattagccagccacatgtattttttgcttctgggtaatagctgtgtattgttctcttatttttttaaataaaggggtctgcatttttattaatgactaagaaatcttgatatatttagaaattatatgtaaaaataattttaaattttttttattctactttaagttctggggtacacatgcagaacttgcaggtttatgtcatagttataaaaaaagaaagaaagcataggcagagaaggaaaatcactctggacagaaaaaaataattggttaaaatattaaagaataaaatttgtaggtaaaaataataaattttaaaatgacagtttaaaaatttatatgtaggctgggtgtggtgccccatgccgatagtcccagcactttgggaggcctacgcaggaggatcacttgagtccaggatttcaaggccaggttgggcaacatagcaagacgtcatctctacaaaaaaaaaaaaaaagaaagaaagaaagaaagaaaaaaaattagccaggcatggtggtgcatgcctgtagtcccagctactcagaaggctaagatgggaagatcttctgagcctgggaggtcaaggctgtgagccatggtcgtgccactgcactccagcctaggcaacagagccagatcctctcgcaaaacaaacaaacaaacaaattacatgtgaaaagaattatacgtgaagataataatttcagacatacaatcctatgttaactcccatagaaaattaagggagttatcacacctttgcttttaacaattctttctcttcccacattccagttttgttgaaataagcagagcttcttatcccagcttattgtagcaaaatcattatagtaaaatgatatttttatttcaagcattacaatagcactttataacttatttaaaaatttatatgatgttaaaaggattcaatactcattgagtatcctttcataacatacatctctaatttcttaatttgaattgagctttctatttggtgagagtatttctattctgaaaaggaacatggccagtgatgtaccttctgaatctttgcgtagttgagcctgtctttctaatgcctgtacccatgaacaatgtctggatgatgatggatttttttttcttataccctttcgtttgtgagcttttaatacattgcatcgtgtttctgaagagaaatctgagacaagcttaaggattatttttcactgtgggtgacccgtttttgtgtgcctgagtgagattcttacaggtttctttctttatccttaaaatcccaggactaccagcctatagtttggtgttaattaatctttgttttcttgagaatatggtaagcttttcttagctgaatattcaggtcatatttttaatcccttaattttggtttctatcatgtctttgagtttatattttcattatttgttttcttcgggctttcatcctgtgaaatttagtgaccaatatagttttattccttttatgtccaagatacataagaagttgtatgtactctagtgtccattcgttcatcaacttattccaattaccccaaacccctatttccaagggcttttcttcttccgttcagactctttatttgggtcttttcgtggttccttgcttaacactatgcacttttcacggcacacactttccctgggaattcttactcacaaccatgactcctagtactattttcatatgcatagttataaaacctgtaatttctaaatttatattgccacagtgctatcagtgagctttcaaaattcaaattcaagtatgatttttcttagttttaagatttcttcagttggaatggagacccttaatgacttagctctgacaactgttcagcctcatgttctgtaaggtctcctctgggacctcacattctagtaacactgagctgtctagtctttaattgtatccatctttcttatgttgctacaactgcacatgttctttaccaagaatactctcccttactatttattccgcttaatcctactttttcctttcactcatttggcatcaacattttcaggaagccttttcttatctcaaaatctgagtagacatgcactcatcctttctatgaaattatcgcaatttactcaatgtgctttatttgtgtccatcactagactccagaacttttagatcaagaattttaccttatttagtgttgttcccttcagggctcggcatcatgtttgaatgtgatccattctcaataaacaaagtttgattgaatgagtgatggcatcatccagtattagaacaaagttgataggacagtttgtttagaagctcttgcaagaatacagttgacccatgaactacaaggaattgaattgcccaggtctgcttttatgtgaattttttcgagctaaacacagattgaaaatacagtacttgcaggatgtaaaatccgactatgcacagggccgactttttgtatccctgggctccgcaaggctaactgcgagacttgggtatgattagattttggttatttatgcctggatcctggaaccaatcccttgaagactgtacagatgagagatattagttgatcgaatatgtagcaggagaaaactgaaaaaggaaaagaaatttatgaagtaaattaatgagaccgctgcatttcattactactttggagattagaggaacaataaaggtgactttaaaattttgaaccaacttctttataacatggcttacaagtggtagctagaaagaggagggttggttacttttgctttgtatattgcaatacatttctgattgttccctttccacttttccccctagtattgttgattactttgtctttgtaaaaaacttcatcgtgaaaatttctttctaaaatgtaaatgtgattacctccttcctctccttaaataaacactatgctcacgattgctcacactccagagaatgaaatttccttcccttagcaacatgttcaagatccttcaaaatttgttagatggtgcctctatagcttcattgtccttctatgtactttgagttttaaccatgatatttttttgcctcccaaaatcatgtactttgtggttttcatgcaagctcttcctgtttgccttattcagttgcttctagcttgtacacttttccctctccctcttcaactccatttctttgtgtacgtatctcaatgaccaccacaaatacaacttcctctgtaaaacacactaatttcttctctccttttctcctctctgctcctatagcacttttttttcttattggctgtatgacatttattacataggcatattttattagatattaagtaggttttgcattaggtatatttttgaatgtactgaaaggcagatactttattcattcatatgtgctcagaagagcaaaatatctcttacataatgtatgtttaatataagtaaatatacaaacaaatagaaatattgagtttggtaaaagatgatattgagaaaaagtgatatgtgatagaatgaaaagctacatatattttctaaatgatgggtggacatttacaactttgctaaattatatattaaatcatctctttatcctgaaaaaattatcttttccatgattagtaagtactttacagtctcttctaggttataaagctcagtactctaattagttttagaaaaactgtgactaaactagcagtactgttttttctcccatattttgtctcacactgaagtcagtgatatttttttctgttcacagatatattcactcttagccttccctgagctctattacagcctggaaaataactggaatttcctttaaaataatacacattttcttaacttatcatattaaatgaaaaacacacaaacactggcctcctttcacattccctagaactttttgttttttctgtatttggcatttctgatgtctttaattttttgtgattctggctctgtattctggtgcctggaacagtgttgcttccaaataaataggcagtagtgatagcaatactcataaatattttaagctatttggaaaaagatattttttagaagctgtgttttgaatgaccttcccatttaactacagtgaatttcattcttagttccttcccaatatctaccctcttgcatcttcttttatgttgtttctaacgtcttttgcggtacctatcaatttactgtcatctactgttttcattaagattgctacttgtagatcattaataaaaaggtgaaataaaactaaattccttatcaattctctccttaagtcaataagtatccagttttaaatgacagtgcttgaattcaagttcatattaaatgttacttcaaataagtttgggagtttacacatacatggctctttggttcaattacatttgtcttatttattttgttttctgttcccttgtagtattctttgataaacttgtcctttaaaatatatattccaactaaactctgcttagggcctaagtggtgtagccctctggggagggtcgcaaatgtaatttgtttgattggatactcaagcttttcaattgttttcttttccttagagaaatagaacctttctagctttcaggtcaattgatgtaatggttggattcagatggaatgacactttctccccattgtaagtctctagttcctcagagaaatccttgggaaatctgttgacaacttgctgtcatccagctgttctgatggtataaatgacttagacactgattcctggtagtttaaaagtctaatggaacagtgaaattttgagatctcaagtgcatcatgaataaagcacttaagtagcacttgtatatacttcttacaatttgttaactggttttctgctttttttttttgctggagaaagagatttacagttttaatctgattagacattagcagctggttgaagatgctattactgtgaagtatggaaaagaacacaatcatgatgaaaactttttactcaaatccttagaagaagaaagcagatgaaattagattggcaaaggaaaccagcccaaattacacacaggagagaaatgtagcagaggagagtactgagttggtgctgcacgcatagagcttacagcctccatgggcaggggacatgtgggtgtgactgccagggacaggaattgcaaacagcatttggagtgacagtctgggtcagcttctcatgctctttcccatcaccaggcatcagcgagtggaaagatttgacctgattttggagcacagagtgtgggctctaaggccacaggaaggcaggtgaatgggactaggatgtagtggagtccccatggctaaaaaataagttgtattgcatacctgcctttgccccacaattatcaaatccaatctagggtgaatagaaacacatctgcagacagatccaatgtccacctacaaaaagtttcagaaaatgaaaacagatggagaaaaaaaattataaaaatataaagaattctggtaaagttgccaaaagaaatgagtcttctagtcaaatgggctttgttctattagtagatgttgagacgaatgcagtgaattgattagagctgatgttatttgtttgggtgcatacatgtgtgcctggtgaggggtgggtgagggaagaaaaaaaactcaaacaaataagaaacatattgagagaaaaataatacctagagaattaaaatagtacactataacaaagtttgtgagtgattattaaggcttgtgtgggtattcgggggctctctgaggtgtcaatatgtaaactgagatctgacagtaaagactcagctaccttatatctcttcatccctacatcttgttctaagaaaacatcagaagtcctgtgatctcagcataagttgaaaactcgtaagtagtcattcaaaggtggatttgtggagggtagaggtaaactaccttgattatatttacatagaatggaagtgatgctaatttagaaatgtccattgctgtaagtcttaggagatgtaaagtaccaatgaaagatcctgaacagtattatgtgacagaaaatgagcgttacacttttaaaaaaatattagatgttgtaactttagtcattctcacctttaccttttaagtatttcaccatttaatatcaaccttcattattgatttatttctaaagatatctggaaatagtttaggctcattaattttctttttaagagtcaaatcggcatgcaaatgtttctcccaccaagaaatttttttcctggacttcaccttctgaggcatgtccacctttgaggcaagctaagccaggctttgtgaaggcagaaccatccgaagcacacagccccaccaaatttctctccctccttccctccctcccctgttcctctctccttctctttcttttttctctttctttctctttctttctctttctttcttccttccttcctttctttctttccttctttctttctttctttctttctttctttctttctttctttctttctttctttctttctttttatttctttccttctctttctttctttttatttctttccttctctttctttctttcttttttttttctttctctttcttctctcttcccccctcccctgctctcccctgctctcccctccccttccctttctttcagctgctgcttacctggggtaacatggtttgggaagaaacatgtcagaattggagtgaataaatataaatgataaaaagacaaaatgaatattattttcaagagtaattaccagtatgaagttcttcagatgataacaaaaactattgacttattttgtctaaatcaatgccactatcttatctgtgtgattgtgaagggaggaaaggaaactgttcactgaatattctgcatttgacccgtaaatacctacttttgtattcagggatgatatattcttaccttaaattaatgactgttttctactgttcttttttggtgcaaacaaattaaatgtgtgcacttctccatgactgattgtgcaaaaactgcttagacaattactatctctctagcttttgatcagaaaggactaccttgaaacaatggccacaataatggtattattctcaattctagaatttatttaaacaaacaattcaaatcatatttcataatacagttctctgaaggagcttaaagagattcagatttttccttttgtttaacatggctcttcatttagtttttgaggcatatttttaataaattttgctcagtactgtctactggagctgaaaaaatctaagaagacacaaaatggctgaagcataggtacttacagaaaagcatgcctttcttttaagaatataaaattaatacattatttatttattatataatgggatgttctacccttgttgaagattttagcagatataactcatgcacagtgtaagtgagcattcacccctgttttgtttatatggcaggactatttctacaaattttacaaattactgtttaggatctttatgacatccattgagtgctggcatgataaatgattttctatatatctgtctacatattgagggcctgattgatggcccttctgacttggggtcagcagtgagttcacatctcttggtatactttggcttattccctggaagtataaacagaaatccaatgaccactattttcattattttccttcaggcataatctgacctaatgatatgtaactgtattactgtgatttaagagatttttaaaaaactataaacattttgaggaaaagtgaaaatggtgattttaaatttaacacatttaaatattcattttatgaaaagaatatttgaaagaatagggatttatcaggatcaatagaaggcttggagtaacctaatcattttaaattttattccttcttgtttttttctgttttcccacaacttattcactaccctctatattctcatactttgctaaatcatattaatccttcaagagttggtttagatgaagcttcattcatttgataaagattaaatgagtgtccagtagttgctagctcaccttgttctgttgtgcttcacagacaatgtgttttatttttatttttattttatttttttacaaagtgaaggtttatggcaaccttgcttcaggcaaacatgtcatatattagtgctatttttccaacagcatgtgctcgttttgtgtatgcttcacattttggcaattctcacagaaatttaaatttttttccaatcattatagctgttatggtggtctgtgatcagtgatttttgatgttattataatttcagggggtgccatgaaccacaccaatatgatatggcaaagttaaccaataaatgttgtgtgtgttatgacttctccaccgacagaatgttcttctgacttgttccttctccttgggcctccctgttccctgagacacaacaatattgaaattaaattagaccgagtaataaccctacagtggcctctcagtgttcaagtgaaaggaagagtaacatttctctcacttgaaatcaaaagctagaaatgagtaagcttagtgaggaaggcatgtagaaagttgacaggttgaaagctagtcctcttgcaccaaacagccaagttgaatgcaaaggaaaatttcttgagggaaaattaaagtgctactctaatgaccacaaaaatgataaaaactgaaacagctttattgctgatgtggagaaaatttgagtggtctggatagaagatcagaccagctacaatattctcttaaaccaaagtctaatccagacaaggccctaactattccattatgtgaaggctgagagaagtgagcaagctacaaaagaaaagttggaagctagcagagattggttcacaaggtttaaggaaagaagtagtttccataacataaaagtgcaaggttgaaagagcaagtgctgttgtagaagttgcaagttatccagaagatctagataagatcactgatgaaggtggctacactaaacaacataatttcaatgtggatgaaaaagtcttctgttggaagaagatgccacctaggactttcatagctagagaagagaaatcaatgcctagtttcaaagctccaaaaataagactgagtctcttgttaggggctaatgcagttggggactttactgcacaggtggtaggtgccctaacccccatattgttaaagggtcaatggtttatagaaataatatagaagtaagtgtgtgattctatctaatctatctatctagtagtatctgtctatattcatattccctatatatccatagtccctacagccatccactgaggggagagagtgggcctgggagtagtaacactgaaatagcacgaatctacttagcaccgaatctttgttcctaaagaccactcatctcttagaggaaccaggattccttggagaaatggctgattccagggctgtggtggggaagtacaaaatgagcctagaacatcttgtgtcataaagtaagaagatacttaaagaattattagaacatgtcaatatgatccagaatgcagctgtatggggtctatactgtccaaacctggaacaacttgagcactgaaatacatattgagagtaattaattatatcccactgagtaaaatagagactcatgagtctatatagataaaaataagcctaagcatatattgaatttttaataagcaataggatatttatacagtcttgaagtatctgctcgcaaaatgtttgctaattgcaaaggggaaaattgtatttttacagtgtggaagcctggcagatatattaatgcaaatgattaaagttaacatcattaataatggaacaaatagaaatgatgtaagacatgataagatataatatgatcactgtatcacctgaatttaatcatgaggaaaaattagacaaacccaaattgagaggcaatctacaaaataactgggcggtcctctttaacagtattaagatcagaaaagccaaggaaagattgaagaactctttttttttttgggtcggcactgcttttttattttattttattattattatactttaagttttagggtacatgtgcacaatgtgcaggcttgttacatatgtatacacgtgccatgttggtgtgctgcacccatcaactcatgatttagcattaggtatatctctcaatgctatccctcccccctccccccaccccacaaaagtccccagtgtgtgatgttccccttcctgtgtccatgcgttctcattgttcaattcccacctatgagtgagaacatgcagtgtttggttttttgtccttgcgatagtttgctgagaatgatggtttccagtttcatccacgttcctacaaaggacatgaactcatcagtttttatggctgcatagtattccatggtgtatatgtgccacattttcttaatccagtctatcggtgttggacatttgggttggttctaaatctttgctattgtgaatagggccgcaataaacatacgtgtctctttcagatcaaaagaaaacttagagtcatgacaactaaaggcaacatgtgatttggggctggaggtgttttttctataaaagactttttggggtcattgacaaaacttgaatgggctttaaagataaaatggtaatgatatacgaataactttgatgtttacatcgtgcttatgtaaaagaatgtctttttgtagcaaatacacgttgcggtattcagggggaatgggtcattaggtcaaaaatttaatctcaaatgggtcagaaaaaattctttgtactactcttgtgactttcctgtaacgttgagatagttattttttaaagtaataaaaaacagaaactactgattgagctgcattacagatagaatgggaaaagagaaaatggacagaggaagtacaaacaacttacttgaggaacacctcaatagagagaagaagagtaacagggaaatatttggtggaggagacttccaagatattttcacgttctcatctttgttcctaaccactttattcatatttatttattatattgcctcctttcattgaaagtattttatacgccatttctattacagattgtaaattccttgaagaaaaggtctgtgctttatataccccttatgtgtagtatatgtagcatcacacttagcatatcataatgtgcttgtttcatattcaaacaacaggaccattttcaaacaagtgattggattttagtgagagtatgaagagcagttttctttataaacatgggagacaaaagaggttgactcacttttaaggagaggacattgtagttataacaagtaacttctagctcattgggatgtaacatgctgaaaaagttttctaaggtattttacagctaacttgataatcttttggaaatcatctgttctccatgagtaaaatagaaaaaggcacaatgatatattgaaataattaagagtatctaatattgtgatgaagtgtgcaccaaaagctttcttaaatgtagaagtgtacatgacacctctttaagcagtatctacaaaaaaccagctggaactctccctattccttaggaattcaataaatcagactgttggcagattttccatcatgtatatgtgtaaattaatagcttttttttggcagtagagagaagagagtaatctaaatgtgtaggaagaagaggccatgagagtttcacatccagtcaagataggacaaaaaaaaatctacttgcattcctatgttaaatttttaaagatcaattaaatggagacttgtttggtggaggttgcagtatatgaagagctttaatagagatgaggggagaacagcaaatccagagaatcatacccagggcacaaatgtaatacacgtaggctttttctgtagattgcttcaagagcctggcttggcttgtctgagttactcagagaggaaaaaatgaaagtgagtgtatatgttggtttggggtgtgtgaaggtgtgggaatggagagaagtggacagagggaaaatgtgttgaaataaaacaccaggagctcatggaaaatgcaaaacagaaacaaaaccaagaaaaaatctttgaggggcatacctgtgtatgaattcatttttccatagcacctttaacatagtcaaaacaaataaaatttaagcagttattcagtcaaactagtagcaggtgcacacacacattccaaacattacaaatatttgtgggccacccacctggttaatttctgccaaagcaactatccctgaataatttcctcaagtacttattcatattgtttgtataaacgtcactcaatagagaatatttaataaactggagcatttataattatataaaaattcatgtcagtaaacaaggccactctgaaaagttatgtgaagaatcacagtatgacacattttgttagaaaacggtgccttttctttattgcttagagttgtaacatcacatagttcatgttgttgttttcattttcggggtatcaattagttgatcaatcagttagtgtttattaagcttctgtccagcaggtaaagcatgctcatcaaatttgcaaatgacataaatgttagagggatggtaaaggcactgcatgacagacatagcatccaaaaagattttgacagctcggagcaataggctgaatctaacaagatgaaatataacatagataaatataaatgcctacctttgggtccacaaagccaactgtacatgtatagcattgagtagatgtgaattagctgttgatgtaagcaggaaaaaaaagacagtattttagttaatagtcagctcaacttaatttatcagttttagctgcatgatgtcattgccaaaaatctagcctgcaattttgaattgtattaaggtgacaatcctgtaccagtttgacaggtcagaccacatctagagattgtagtatttctggagccacattttaagaagagagacactaaaaactatgtcatatttagaacatcacagaaactaaacacatttatcctgaagaagacttaggagaggaatgacatccttctttacatttatgtaagctctcacatggaaaagggattaaatttgtttggtgcagtctcaataattagaactggaacttgtgaactgaagttataaggagatacctttgggttcaatcatttataataattacatataatagtaaaagctgttcagagagaaaggcgttcccaaaatctgcagaggcagaatactagcacagtttagcctgagtgtcctcctttgcaaagtggggacaacaccattgtgaagcagcgatctgggaaggcagtgggatgatatagggaaaatgttcagcacaatgaggggcatgtagtaagtaagtggttatagtacacaggggatgtcacctttcctattgtgggaggtggtgacaccaatcctgaatcatcactgggtagaggtatagaagagatgctaaatggatggatttgacaaactgactgttacttcaaaaccctaactgactgcaacttattaattaaatttgccatttaaaactgtctctgaaaccaccagtcacgcttctatagcaccttgagtatttttttttttttttttttttttttgagacagagtctggctctgttccccaagctggagtgcagtggcgcgatctcggctcaccacaacctccgcctcccgggtttagcaactctctgcttcagcctcccgagtagcccggattacaggctcgtgccaccatacccagctaatttttgtatttttagcagggacagggtttcaccatcttggccaggctggttttgaactctttacctctttacctacctcgtgatccacttacctctgcctcccaaactgctaggaatacaggcgtgagccaccgcaccaagctattctttttttcttttttttctttttttggatagagtctcactctgtcgcccaggctggagtgcagtggcgtgatgtcggctcaccgcaacctccacctccccggttcaagtaattatcctgcctcagcctcccaagtagctgtaattacaggaatgcaccaccacaactggctaatttttttgtatttttagtagagacggagtttcgccatgttggccaggctggtctagaacttttcacctcaagtgatccgcccacctcggcctcccaaagtgctgggattacaggcacgcgccattgtgcctggccaaatttttgttttcaatcctctgtgcttatttttaattatctttaaaatggagaaaaaggtaaacctgccttaggtaactgtaaagttaaaaagaatgaatatgcataaatattttagaacaatgtctgacatactttttttttttttttttttttggcagagtctcactctgtcacccaggctgtagtgcaatggcgccatcttggctcactgcaacctctgcctcccgggttcaaaagattctcccgcctcagcctcccgagtagctgggactacaggtgtgtgccaccacacccagctaatttttgtatatatatatattttttaagtacagacggggtttcactatgttggccaggctggtctcaaactcctgacctcatgatctgcctgcctcagcctcccaaagttctaggattagaggtgtgagcctccatgcccggcccatactagctttttaatatatgttaactacttttgtaatgccaaagtaggtggcaaaggattattggagaagagaggacttgagatgtgtgttttgaaaaatactaaaaatttagttaagtgcctatatggaaatagcttgaacacatcatgagattaagtggtgtgtgatcgtcagacagtgaggagactttaccagttagattggaggtcggctgttggtgaaggttagaaataaattgggtgagatgagtgaggaaaaatctcagaaggccttaggtttaggatggtaagcaataggatgggatgtgtggggattccacgtgttcgtaggtaggggaatacaacatacatgtgatttttaaaataaacttatagagttttcaggatacattgccttactttagcttaaaaattatggatggaatagtggaatctttttatgcaaatccttctttcacttagaaatagaaatttctatttcagggcaatttctatttcagaaagtccaagacttttctcctccataaagttttctcttctgattcatattacagtggttttctttttgtttgaatttcttagcattcaaaatgatgttccttatatttgtatcatccatcatgatcttttaaggggaaatttaaatttaagatacgttgtcaaatcgcttaatgttaatctattagaaaggtgttattctgaatgcataaaatggttttgctttaaatgaggccctccaaattaataaaactgctcttcctgggaagcttctaagttggttctgggaaagcaagtcacacagagaaggtccaaaaatacgttatacaccacatatattaacaaattaagacataatttctcaaagcaactccttggaaaagataatccttcttgactgcattaagattcagtatttaagttagaaacaaccatcatcatttatagtgattcaaacactatctagcatattaaaatgtattttgttgtcatcatacatacaagctccttgagagaaaggatcatgacttaactcttgttggtgtagctcatagggccactgtgggtaccgagttgatgctttatgaattcagtttaaattagaagaatgtaggcaatgggattaccatttgtccagtaacaaattcagcacaggtattctgtctctctatttcccagcctgagtcagcagtttcttttagttctgatggccagcaggagtaaaatagcagcaaagatctggcatttcagtggcacaggtgattgtggaaaattactataatctaggtggactcgattctattttccccttgctaggtactgagatattgtgtaactttctggacttttgaattatacttctcactaatctagcatgagaatgggtggatagtgtcaagaattctacttaaaaaaaaaaaaatctagtgtactcttgtactcaaagggatgagtacaatctatcacagggacacaaatgtgaccaaaaaagtggttaaaataaaatatgaaactgaagagaatgaagatttgagcatgaccttctctgtatcttctttccaaagtgttttcggatctcttatgaaggggatttaaaggcttttctacaactgctactgcttttgtcaattcattcattcaagacacaccaataaacatgcacgagctcctcttgtcctcatagggctagagaatgagataggtgcaaagtttattttagcagaaggctttcttttcacaaatcagaaattccattgtatgtattcccttaaataactggcaaggggaccatcggaatgagctatggcaaaaatccacctcagtctttacagcttcagggtgatggggccccagatcagaattgtaaaatagtttagagaatcttggaacataaaacatggtgcagaaaaaccaaggaagatttaatcttatgtatggaaaggtggttggtagtggagggggcaatggaagagagtggcttgggatcatcattaatcattatttaagtacctataaagtgaaaatatccttctggaattcactgcaagtgacactgaattcttctactaagcaaatatgtgatgagttgataaaaaagaaggtcctgaactcttgacaacagatataatacagtgaatacagaaaatcaaaaacatgctttctatctgactcaaaataaaggtgcacttaaacttgtaaaagacaacatttttatttgaatgatatgacagaagtgtcacgggagtgttacctgctataaagaaagcctaagaattattacctttattagaccagtgacactgagctttagccatacatttctaacttctgtccctctacagagacaattttcttttcttaaataaactgtcatgctagtgttaatatattgttggctctctcatgctctgagaatactgctgatataaaacatgtatatgttagattggtaatagtatctttagtgtagctgactagaacaaatgtgtttccctcatggctgtgctaatgtgataaaggaaaattggctgttcatcagcttttggctgggtaaagacagtagagatggaaccacattcttttttatgcattaataccactgagaacttttcactagttatatttcatgtgcctgcatgttgtgcaaagatgttgtaaaacatgagataatgctacaaataacaaagtagaaaagcctgtatcttttataatgataacagtcaaacaccaaatgacagtaacaggctgtaaaaaatgggatgcaaaaaaaatgcagccctactacccaacaaagcggaatatatccaggcccttgaggacttggtatatgatttgaggtatattaaagctttgttttaaaattaaatcaaatgcaacactagatcaatggatttaagaaagaacatagtttaaatgaaagtagggtggttagaatggagaaaagccattgtgggtaacttcttgaaataatccgtattaccaagtaattattgtagtaacttcctgttttttttgttttgttgtgttttgcttgtttttttggggggggacattgaaaaagatttttaaggcaatagtacacatgattttaagatgtttgagaataaatgtttatcttcattaattattgcaagtctttttaacataaaagcattaaaagtataaccagtttcaggctcacagcaaaactgagtggaaatttcagagatctcccaaacatgctgtacccccatgtacccacagcctccccctctattaaagccctgcaccagagtggtatatttgttacaattgccggacctacactgatacatcattaccactcaaagtccatagcagaatagcatgttgaatgttttgctatcattttaattaaaatgttaacatccaacctttcctttgcatgaccttaaatctcactctttcctcccctctctcaacccctcccctttccagagccttttatttgccatttcagctccttcactaattagagtaccaattattcctttttcatttaagctaaaagcacttgaacaaaaagactatttgcagagatgaagttgatgtccaaacagctgattagtttatttagaagtgtatgcaattaaaaattttgtgcaggtatctatgggtgttttccataaaagtttgatagcattggctattctgggctccagtcgcataaacaaaaatcccatagctttttaatcatgtaatccaagagttatcaagctacaacctgtgggtcaaattggctggccacctgtttttataaataaagttttatttggacacagccatgcccatttgtttatatattgtctgtggatgcttttgcattacagcattagagttgggcagttgtgacagtaaccatttggcccataaaaccaaaccatttgacttgcagagaaaaaaacattctctagctatttacagaaaaaaaaaattgctaatccctaatatgtgcagttattaggctacttgcttgattgattagtctagaatatgattggcaactttttgttaccctacattggaaaagtatatctgaaaatcaccaaccggataccaatacccaagacagtaaattcaagaaatatttgatcctagtaacttgaattatatccacatgcaattctttgttgttatatctggttttaattatttctttcccttgtactcattttgctctatttccaaatatagccataacaaatttaatttgtatttaaagaagtaacatatcctcaaaaaccctgtaaaacatggcaaccagagctgttacatgtatgggacaaactattatgtatacctgtgaacaccctgggagatatcatcacagcacaaaatgacactatataggtttatatctagataaacacatggagatatcactgagctattaaaataatgttttcagtcttcccagctgaacaaagtaaagaagaaagaaagttacttaataaaaactgctgaaatgtgtttaatataaaataaaagtttatgcacttaaactaataatggtggtaatttcttacaggtgcatcagacaaaaatcagcttctttatcaatggcgtggagaaggatcatacacctttcaatgcaagaactctaagtggttcaattacagattttgcatctggtactgtgcaaataggacagagtttaaatggtaagtttctgacttcagaatgttatttatttcatccaattacattgttcttaaaaatgcatcaaacaaataatattttaaaatatctacgtgtattcatcttctagggctactgaacaaattaccaccaactggatggcagattaatgaaagtaaaatttattttttcacagttttggaagctggaagtcagaaattaagggttcagtggtgttggttccttctggaggctctgagggcaaatctattccatgtctctcttcgtggtagctactggcaatccttagtgttcctttacttgctgcttcctaactgcaatcttgcctcagtcttcatgtggccttctcctctgaatcttctcccctttacctctgttataaggacacttgtcattggatttagggcccactcacagtcaggaggatctcaccctgagttccttaacttaattatacttgcaaagaccctttttccaaattaaagtcatagttacaggttccagatggataatagatcttttgggatctactatataacttactacatttgggaagctttcaaatataaacttctttattctgatcagtttttaagtaatttcaatgtgtaataaactatatttcctttctgtctcttttctgaggggtttgcattttcatgtagagaattgttaaagtagaactacgaagtattagatggaacctgagaaatagtattgacatgtaattaactggactgatgtttacatttactacattaaaaatgggccatatagtttaagaagatatcatatactatatattgaataaaaccagaagttgaaataagaaattatcttgaaatatctagtacagtggtctttaaaatgcctgcatattaaaataaaaatagtattttatattattatataatatatgctcattataaaaaaatctaaacaatatggaactctgtgaaatagaaagtattttccatatttctatcttcagagatagatataatttaacttttttatactcctacagatttttagtacatttttagctagagatatagttataaatacatttttccaaaaataaaattacaatacatatgcttcctctgagccttctaaaaataaatacttctccttcaaatgttataaacaacgtttcatgtcaatgtatcttctcatttagatatatgttctcatttaaaatggctgtattctatgcaattgtatagttgcaatccatgagatttcttaagctcctataatgaacatttaggtttttttaatgtttcagtgcaattagcagttattttatggaaaatattatatatatatccacatatatttatatatctgtgtctatatctacatttccatttatatatatcaaccatcaatctatcaatcatatacatagatgtatacatacgtacatatgtatttgagcagttgcctgattgcacagttccttaatatcctatttggtgccaacctgcgtgaattcatatcccatttcctcacttactagctatatggcctggcaagatattttaatatctctaaagtgtagtcaccccaactttaaaatgatgatgatgatgatcataatattgatttcccatagggccaatgtaaggatcaaatgaagcaatgtcatgtaaaacattactgtgtttcaagcacctggcatgtattagatattcaatatttatttgttaaatgaatgaatggatgaagtgctaagcacaatgcctgtatataaactatattttctctttcttgggcatggggctggattttaatgtacagcattgttaaagtaggactgtacagtattagatgaaaactgagaaataatattaacatataattaactggactatgtggtttatattttcgcacactaaaaattggccatgtagtttaagaagataacatatatgctatatattgaaaaaaattactaaactatatcagtaaataataataatattattattttattattatttttttttgacagggagtttcgctcttgtcgcccaggctggagtgcagtggtgcaatctcggctctctgcaacctctgtctcctgggttcaagtgattctcctgcctcagcctcctgagtagctgggattacagatgtgcaccaccacgcctaacttttgtatttttagtagagatggggtttcaccatgttggccaggctggtctcgaactcctggcctcaggtgatccacccaccttggcctctcaaagtgctgggattacaggcgtgagccaccgcaccctgccgtaaataatactattattaatgttattataattatttccaaaaaataaattcatagaagttgaatggctgggttgaagtatatggtcattttatattttaatacatattacagagattgctctaatgcataacaatgggctacctccagaaaggttgtgaaaatttataacctcattaaaatatatagccaagtacttgtttccttaaacactaactatccttacaaattatccacttttttttcacccttgacattcctctaagtgaaaaatattgttgaatgctgactcagaattatttggccattaatgagtttgagtagctttttacgtatgtcttgatcatttgcatttcatttatgaattccttattcatacaatgtgtccatatttatactctataattccttatttatttataaaaactcatttatgttaagaatattatgttgtataagttttcttcagttttttgatggcttatgaactttgtggtctagatattttaaagtaatcctttaatatttaagcaaaataaaacatgtatgcaagatagtgcataaatataaaaggtatagcttgatgagtttttaatatttatatacacctgtgtaactctcatttaaaaaaagtcgtagaatatttccagaatctcagagtcccctaatgaacatccactgtaaagataaaaacagaatagcatcaatgtagccctctataaccatagattaatgttgcctgttctcaaactatcatacaaataaaatcatgaagtaggtactcttttgtgttctttttgcttagcactatgccaatgagatttttccatagtgtatgcagttatatctttagctttagcaaataattctgtaaagttttccaaagtgggtgtcccaacaagcaacatttgaggatttcagttgttccacatccttatcaactgttagttttgccagatgttatcattctttgccattcttgtagccatgtagtgcatttcctgatcattagtgatactgagatcttttcatgtgcttatttgccaaatgaatatgcttttttgggaagccttttgccaagttttaattggacagtttgtatttttcttaataatttataggaggtcttccatattttgaatatgagttctttgacaaatacatgatagcaaatatggtcttctgggctaaggcttacagtcacattctcttgatggtatttgtcgataagcagatcttcttaattttaatgagtctaatttagtcattgttttatacttaatactttttgtgttctgtttagactatttttgcaaaccctgatatcacgaagatatcctcctacagtttattcaggaagctttattattttacttttcaaattttggtctatgttctatctggaatagattttttgaggttatataaggtaggggtcaaaatttttgtcccacctgaatgtgtaattaacctagaaaaccttgcctcttgaaacaaatcaatgtttctaccattctgcagtggtaacgttgtcgtgaatcaggtctctgtatatgtgaagatgggtttctttctgaactttctattctgccccagtgatctgtctgtctgtctatacttgggccaaaatatttagttttaattactgtaacttcatacatgtcttcatatctagtagttctccaactttttttcttttaagattgccttggctattatatatgaattttagaaacagtttttcaattttcataaaaaattctgttgagatttaaattactcatttgtatttaggagaatgggcatctgaacaatatcaagtatccagcccataaatgtaatatattccttgatttctcccagcaatgtttttagttgtctgtatagaggtctcactcctatttgttagacttgttcaaacatattcattggttttccttcttaatagactatttttttagagcaattttagagtcacagaaaaattgagtggaaagtatagagagttccagtatactctctgctcctacacacgcacagccttccccattgtcaatatccctcaccagagcggtatatggtatatttgttacaattgatgaacctacattgacacatcattatcacccacagtccatagtttacattaaagttcactcttggtgttgtacaacgacaagtatccactactccagtatcctacagagtagcttcactccctaaaaatcttctatgttcctcatattcatccttatctctatcctaacccctagcaatcactgatcttttcactgtctctgtattttcaccttttctagaatatcatatagttgggataaaaaaatcatgtatcctcagattggcttgtttcactgagtaatatgcatgtaagatttctccatgtctttcatggcttggtggttcatatcttcttagtactaaataatattccatggttagatatagcatagttgatttattcattcacctactgaaggacatcttggttgcttccaagttttggcaattatgagtaaagttgctataaacatcagtgtgtaggtttttgtgtgaacataagttttcaacttataaataccaaagagcgcaattactggatcgtatggtaagatatgtttagttttgtaagaaactgtaaaattgtcttccaaaatgactatatcgttttacattcctatcagcaatgaaagagagtccctgttgccccacatcctcaccagcatttggtattgtcagtgttctggctttttggcctgttggttttcatgcaattatacttagtattgtttttgaacttcatttgctaattttgttactattgcattaaaatctaatcagtttttatatttacctatgtttagtgaccttgccaaactcattattatgataggtacacaatcctatcatttgcacatatcaggaactcaactctttttgaatgtttgtaataaatgtatataatggacatgccataaatatctcctgtagatatttttgtctgatgcacttattaattctgaaataatataaaatgttattttgtttttctgtatgacctgagttattagaccaatgtctagttttaaaaaagaaggtatatatttttgatattcaaaacactgtggttaaattgccaagctctggtttaaatataacccaggtgtgcttctttgatcaaaatattaactctctttaagtctggtttctaatctattaaatggtggtttaatatataattcataggaatcttataagaattatgtgagatgatgtatgtttagaatataagttgcttgttgtatagtaaatgtgcattaagtggtaactatttttaaactctttgaacatcaattttcttattgtgaaacaataagatagggataacactatatttccatatgattgttgtaccaatcaaaagagaaaatatgaagaccgtattactttagtttgtgtatgctcttagatcaagctaaactcatgtgaagaagcaatattttaaggaacttatatatttaggaacttggtttgagtaattagtataatgcataatcttataaaatactctgcgtgaagaatttttaaataacacattaaatcttgtgagccttatttcaatatttaatccccattagtacttctaaaagtgttttattgcaccaaatgttgctcaaagtatttgatagcgccataaattagtcccctatgcactgcagggttaaaatggcttgcttctattctacttcagtatactaaatgttggattaatgcttcaaaagaacagtgtgaactgaagatgatatttttaaactgtgtagaaataaatttcactcctgattagaaaacatgtaacaggaaaccggtttatttcaaatattatttagttttcattacaactttctcctttatgttcttgacatctgagagctacagaaggaaaaggatattttaaataatttttatctttattctatcaatttatatgtacagtcgtacctactgtatcttttctctaattagagatggcgtatagactggctcattacttctgcctaatgagccaggctccatgccacctctctaatcagaaaagagataggtacagaatgttcctatggacttattataaatcattttctttctcttacttgctcctttttttaatcaaaaaattaagtcactgtcctccatacttttgtccatatccaagatggtttctttcaaaagaggtaattgtgcaagcgattactgagctgaattaaaggtgctctcatgcagtgccaggccggctgtctctgctttggaacagacactgcctcaaacacaagcacatcaaatgaaggcctatagcagatcaagatggatcttttctgtctttctctgattaggtttgacttggttctctgtttctgcacccagaaagtaacaaccttccatatgagtgttggctactacagagctttttctttgagtcttatctctagcataactctctagaaaaatgtgttgccagtgacactttctgttactgcaggacttgtctttgctttccctggaaaagtaatcaatggaccaaatgcatgctttttactgaaccctcatttatccttattaatggtataatctgatttgatcaggctgaattttatgtatacaaatagaaacaccttagaccatctatatcaaccaaagtgtgatggctcctttttagaacattttcttttagttgtagatttattttagtgcttccaattgggtatataacctggagcacttgtgttagcagatatgtagttatgaggagtcagcaatgtcatcgtggtaataaaccatactagctctccaaattttggatttaaaattacagaactacatgaatcaaaacttttcccagttatttctgaacttgtttatcaacagagttctagttgccgattaaaggtgagaatttctacattatacattcaaatgtgcatagcactttcttaagaagatcattggtcattaaggaatcaataaatatttgttgagtgtctgttaaagtgaatatgcagggaagaaaaggatcatcgtctaaagctaactcctacttgccttcctttctgtgttttcaacgttgtgtgtcttagcccatatgcttgtacttgattctaaagttggaatgctacttctaatttctaccagtttcccatgggttcacatttctaacctctgctagatacacaaactccattttagttcagctgaaatcatgctaatttttttcagagagaattatttttgggaattagatttaaaaaaagcttagaaagtattgaaattgactaagagattggaatggaagaagagtataggaatatagtatatagataggagtttacttagtttcagaacattgcagacaaggtatctagcaatattatcagacaagttatgttgtatatttaaaatgatgttaatgtagctctctcaaccatactaagtaaaaactgctgattaattaaaatttgaatgcaaaatatgcaatcataaggtagtagaggaaaatgaaggcaagtgtttctataattctagcatattaaggacctttattagcacgataccatgtccagaaacactaaaggaaaatattgaaacatctgactattaaactgggaatttaaaattcaaacaacgattatcattttgtacttgatagtttggcaaggactagaaaagcgattataccggtgttggaaatagtttggggtaacctggcaaactatcaaaagtaaaaatgcgaaaactacttaatccaagatttctacttccaggacactatctcgagaatataattagacaaagacttaaatacatactcaaaatgttcattgtagaatgatttaaagtaacaaataactggaatcagttaaaaacttcaaaaaggaattgatttaataaattataattcatgcctactgtggaatagtatacaccatcaagaggaatgaaatatgtctctttctatgtacatggcaatgggttcatgatgtgttattacatgaaacaaacaagattgtatagtacaaaattctataaatttaatgtatatgttataaacatacatatacatattaaagttctggaaggaaatatgccaaaatgttcttcagaatgttagtaatgttaatctctatgagtgggattgcaaataattgctttttaaatttctttttgtgcaatttttttcagtaaactataattttataataagaattaaaaatattttccaattttggacaaaataataaatggaagcattttcagaatagatttattctatgaatgtaacaagttcagccagagacacctaatttgtatagtacagagggtggtcttgaaaatgttagtcatttaaattctgtacttgtcacatggattcaggaaacacaagcgttcattggacatttaactcattgtacatacaattattattactataataatttgtgcctgagaagcaaagcatgagatttagaatcagacagatttgggtttgaatgctagttctgcttcttaacagccaagtgactttggcaaagaatataacttctcaatccaatttcctaatatgttttctcatttataaaatgtgttttatacacatacttttcagggtgatcagagagcttataaataacacatgtttgattcatgttaggtattcaataaaatttcgctatcataaatattattgttaatttagttattaagtttattgactgtgatacttaaaattttaacataatggccatgaccatatttaattttttttggctgaaaatcaaaatttacttagggtgagggagaaaaaaagtccagtttagattcattatgtagcagatattttaaaattctgtgttttgtctatgtaaaccccacaaaataatttctctctctttttaaagatctgtcctttctagtgttcttcaatgtttcctgttcatcctcacttccacctgatgctatttcttcttaatccgaagaacctcccttttcattgcttgtagctcagcctgctgaagcaaattctctcagcttgtgtaaaaatgtctttacttttgcaggatattttcatttgatatagaattctacattgattactgttacttcttttagaactttaaagatgttgtttccttgtcttcttgccttcattgtttctggtgagatatcagccactatttatataaatgttttcttgtatactatatgtttctttccttctttctttctttctttctttctttctttctttctttctttctttctttctttctttctttctttctttttgaagcagagtctttcactctgtcaacccaggctggagtgcagtggtgcgatcttggctcactgcaacatctgcctcctgggttcaagtaattctcatgcctcagcctcccgagtagctgagattacaggtgtatgccaccatgccaatttttgtattttcagtagagaccgtgtttcaccatgttggccaggctggtctcgaactcctgacctcagatgatccaccctcctcagcctcccaaagtgctgggattacaagtgtgagccaccatgcctggcctatatattgttttccacttgatgctgttaagattttatttttatctttcatgttatcagtttatgatatgcctaggaatgattttcattatatttgtcctgcttgaggtttgcttaaattcttggatatgtacgttggtgttttcattacatttggaagttctgatagttgtatcttcaaacttttctttctttttttcctttttttgcttccttttctttcttctgtaataagactctagttagattgatgttagagcactagatattgtcccatagatattgggtacagttttgtttgttcctttgttttcattttccccactcttttttgtgtttcagtttggatactttctatttgacttgtctttatttcactggtcaatttctcttttgtgtctaggctgctgctaagcccatctagcaaactgttgatttctaaattatacttttcatttcaagtattttcatttggccgttttgtagacttcatctattggctcaaattcacccatctatttgcatgtattattcactatcacccctagatcttttagcatttatattataggtattttcaaatccctatttgataattccaacatctgggccatgtctgcatctccttctattgactctttcctctctttacaaagggccacattgtgttgatttctcatgtgtcttaaatatttttattgtatgataaacactttgcgtaaaagaatgaaagaggtggaagtaaatcatattttttggcgtttttccctttacaaagaagagcactgctggttctatgagaccttttgaatgggggtgggcagtaggaaagaaaaaataccaaactgacttgaagttgatctgtacgtgggctttactacagttttaatattatttagctcactactggtttcagatatctgtggatagaattgaaaatagttagacacatgtctggtggggcctccttagaattctaatatgtcattctggcctctgtatggctgcttctttcttactccttctatgcctgaatcctctatttcttacctctgagctaagtatgggagtagccctgggtctcgtccaatgagttacatgtccagtaaatgtttgtgtttcctacaaaaggcttattactttctagaatttaattcatttagttttttctgtgcgctctacattttgattggttaaaaaataatgactttagggcttatctggcttgttttggttgttagattgacagcaaagtgatggtcccttacaactttttacatttaaagcagatgttgaactattataacaacatctaatttatacccctttttttctttggcacaactctgtctatacttaactctccaaccctctagattgtttcagctatggctggtcactgactctgaacaaaaaaggtgcatattacttggccccaaagattattttggtagaattcaggcatcgacgttttaattacctcctctaatttttcatggggattttcagcttttgtgggccctaatttatccctgactcttaacttttatatctgtttctttggtttgcctgaaatctgtttactgctaatatttaaaactgaaacatgtttttttataaatctagccattggatcttgtttcactaatgatcatgtggcatcgtttaatctcggtgcccccagcggctctgtttgttcagtttgtatagcacatgcatctcttgtgtttctttttctgtcagatacataatcatattgattagtgtataccccttataccctgagtccaaaaattcctcatccctcccgggatcttcaaatgatttaacgactttccactatctctcactttttgatgtggtctgttccctccttactcaacttaagtttcatggccagttattataaccacttcttttcatggaactggacttccctgccgttttttcttcacttctactatgatcttggcactaccacagcataggttaaatatacccaaagaggacgactcttcccaccttaaactcatgaccatgaacttcctatgtttcctgatgctgccctgtgatcattccatatttccctcattcattcactttcctgtcttatgccaactatttatacattttcctttctcattatcctgatcctcagtgattatattacctccaactttaccataaaaattaacaaaaagaataaaagagcttctatagatttccactgctatatttatccaccactggcataccacctattaatagatctgaccaagaatatcttgcctcatttttccccaatttactgctgtattgtaaaattttcttgtattaatggaacattttcaagggaataaaggcatgttgttatttttccatgaaaaattattcttgaccctcccccatttcttctactagccattgtcttatttatttgctctccttttagcaaaacttcaccaaagtatattcaaccataggagcctttaattcctcttttcaaattccaccatctacagtcagactttagctcaccactgcacttaagctacacttgtcaaatctctactcaccttcacattataaatctaatagttaatttcaagtctttatctttttgacctattaacatcatttaatggagttgatcgctccttcctccttggtatacgttcttcacttggcatctaacactccatcatctctctgagtttctagttgctgcgtctcagtttgatttactggttcctcttcatctacttgacctcttagtattggtaccccaagccttaagacttagctctgctcccgtgtctacagacactcactcccttaaagatcacctccagtcttatagctttaaatgtcatctaagtgacttgacctccaaatataaatctccccaccccagcctctttcctgaactccagacgactctgttacatgtatcaaactacccaaagtctccatttgaatgtttaatttacatttcaaaattaaacttactttttttcaaaatggaactggttttcttaagctctctcactttgatccatatactacttcttccatggtcttcctcatcacaagtgaaggcaatttcatttttccactaagacagagaaaaagatttggagtcatccttgtcaattctctttatctcatgttcaacatttttttttttgttttgcaaaatcttgttggtgttagaatcaaaatatatccagattttgaatccttcttagcacttccactagaatcatcccagtccaattcatggttgctgctttgccgggattactgcattgtcttttaactacttccaggcactccgctttattctcaacacagcagccataattgttctgttaaatatcagtcaagcatattacttctctgctcaaaatgctctattgtttctccattttaccagagtgaaaaccaccattcttactataacctacaagacctaactgagctaacagcagttacttctctggctttatttcttacatttgtttattttgttctccttgttttacacaaattggcctctttgccgatttttgactatgggaggtgcacttctgccttgataccattcgctgttctttcaacctggaacttttcacctcctgatatccatcaggctgactcccttacctgattaggtctgctcaataccagtttcttaaatacatctttcttatcaccccgtttacatctgcaaacaccacctccccactttgggtctcattatgttgctctattcttttccatagcacttagcatctttaatgtattatagaattgacttatttttgttgaatatatctgtttttccctctataatataaaagagaaagcaagattttttttatttgcattactcactgatataccccaggatccagaagattgcctatcacatggtagctactcaatacatattttccaagtaaatgaatcgatgggcagcttccatgcagcattaagcctgtgggtgtgtggaatgcaagaattgaagcttgggagcctctgcctagatttcagaggatgtacagaaaagcctgggtgtccaggcagtggcctgctgcaggggcataaccctcatggccctagaacctctattagggcagcgaaaaggggaaatgtggtgttgcagtctccactgagtcccctctaggacattgccttgtggaactgtgagaagagggccaccatactccagaacccagaatggtagccactggcagctttcaccctcagcaaggaaaaactgcaggcactcagtgccagcatatgagagcagccactggagctaagccctgcaaagtcagaggggtagagcttcccaaggccttgggagctcactcctcccaccaatgtgccctggatatgagacgtggagtcaaaggagattattttggagcactaaaatttgatgactgcccttttgggtttcagacttgcatgggggctgtagcctcttttgtttggctgatttatcccgtttggaatggaaatatttactcaatgcttgtatctgaattatactttggaggtaaataactgggttttgattttacaggctcataggtagaagggaattgccttgtctcagatgagactttggactttggagttaatgctggaatgagttaagactttgggagactgttgggaagggataattgtattttgcaacatgaaaatgacatgaaatttgggaggggccagaggcagaatgacatggtttggatctgtgtccccatgcatgttcagttgtaatccccagggtggaggtgatacctggtgggagatgattggattctggaggtggatttttcatgaatgatttattgtgatagtgaatgagttatcacaagatctggttattttaaagtgtgtggcacctcctcccactttgctcctgctttccacatgtgatgtacctgcttctccttcaccttctgccattattgtgggcttcctgaggcctctccagaagccaaacagatattagcactatccttcctgtaaagcatgcagaactatgagtcaactaaccctcttttctttctaaattacccagcctcaggtatttctttatagcaaagcaagaatagactaatacattatcctttgttactgatgtctaaaaatcttttttaaaaaaattaaaagcaagtatattaagacagtaaaggaataaaaaatggctactccataggcagagcagccccaaggactgctggttgcccatttttatggttttttcttgattatatgctgaataaggggtgggttgtttgttagttttccctgaaaggggtgggcaattcccagaattgaggatccctccctgttttaggccatatacggtaacttcctgatgttgacatggcatttgtaaactgtcatggtactgatgggagagtatcagtgaggacaaccagaggtcactcttattgccgtattggttttcgtgggttttagctggcttctttactgcaatctgttttatcagcaaggtctttatgacctgtgtcttgagccaacctcctatctcatcctgtgacttaggatgacttaccctcttgagaatgcagcccagtaggcctcagccttattttacggagcccctattcaagatggagttgctctggttcaaaagcccctgacaattaccccctcctttttaaaagaaagctcttaatcttaagagttgtagagggatgaagatccatcttctctaacttcttcaagctgaataggggtgatgatattcctgcctaacaattagggtctcttgtctttgggatagagaggaactcaatcagaaaatgctggtatgtcaaggtccattcagaatacttgagttctgacaaaagttgatacctggaagattaataagtatttaatttaagaaaacattcggtaagcttatcctacacaaagagtataacagcaatacattccgcagcagtaaagcaaaataaataaaattatcacaactaaactaaattagaagactttccatgaactgggcaattgttagaaccaagctaatatgtggttgctagtaaatcccagtatgtgcccagaattagaatattgatccagattttgacattgcccattcattttggttttttttgaatagtagtcagagatcacttggtggtacacagaaataagcagagtctgtctaaattacagaaaaaaaaccttaaacacaactaatgagactagaatctaataacaggtgtaccatagtttttgaagcaattctttttcttttcagtctctcatttttactaaagacaaattataatagaatcgatttgtgcgcaaaaatgagctttagtcttatacttggcctgattacttgtataaaatgctaaaaaataactatttttcacataggattttaaaattggctttgatggaactttgttccataaaaaggaatctcagataagacctttttaaagctgagcccagccctgggtttgtacaatcaaatacctatgagttgggttaattcctttactcttgaggtcctaagatatcttcgggcccctgagtctatcagaaagtgacattctttacttatcacaggtcaggaaccctgtacagggcatgtgtaaacaaagaatgtgaccagttttcccaaggggtttttattggctttataagtcaagattgattccttaaaggaaagcacaccattccagtgaaagtcttggtaaaataacaaatttttccaattgtgtcctgttacaaaataaaacagatgcttattgcacttatgcaaatatctattgtcataagttaagaatactcacaaatagtttctaaattctgaagaaattaggtagaatcaaatatgccccaaattttgtttacaggagtaaaatttactcaattgttaaaaagctgtaaatagcttaaaagaaaagttgccttggctctgatagcaaaacaaaggatcagcaacattttaagcaaaaagttttaaaagattacttcagctatctattattcagcccatgcagttaactcttgttcagcttgatattcatgaacatttcagctctccatcagtactgaaagttttatcctctcttctaatgtcacaatcttcaaagttattagaaacgtgcattcaagagcacctgtcaaaatcctatagctgactctaaacttactttttaaagaggattaaaacaggtcaacaattttctatggatgacaaaaagttttagaacgacatatattaaagccacaattgataaagaaattttggttagttctgtgacatacaatgattttactgacaattataactattactgataatgtacactaagtcatatcagaattacaggactttcccataattttggaacacaaaccaataacatatttttacaaatacagtccaaagaaagcaaagaccatttcatatttttctatgcttcctgtatgatatttataccaaataacctgaatatgccattttggactttaggccacctaatagctaagagattaattaggtcagaagaagacatactttgtaattttattttggaaagcttgtcaaatattaaaggtttaaaacactggatatcacaaaatataattccaggtcatcataagtcattcattaggccaaaataataactcaaaaatatttaaaggggaaaaacctttactcattaatagagggaagacttagatctccaaaccatctgtctcttttctttcctttcctatataaaatttcttttttagaaacaacctctttgcatagttgggaatatggctaattccacatgtccccaggccttatctagaatctaaagtctccaaagtaggtaaattgaacaattttcaaaagtcaaagaagcagtttctgaccttaaagcatttagtaaacttaatatgtgacctgcctaatttagaccaaatgtctttattttatcaataatttttaaagctgtttttatttcccaaacattcctaaagtcacatgaactaaaagtgattacactttttacttttctgacaaaatatttgatttagacacttattatttttaaaccgattaatcaaagctcttttatatcacatatgcagcacatataaatacacagacagaaaaagatccagtaagatttttcatttttcggtttcttaactggattactggcttcagggtggagccttagaggaacagagccaagaatgcgtgaaatttctaaagcctaataagcaggcacagctggaaggcaaactagatcttcaggaattaagggttccattttaatagcagattctggatcccaaaaagagggaattagcccatctcccatgggagtcttacctctcagtggggagtgggggcatttccataacttctaagtgaccaagagcatgcttctctgatccaaatgtgcaaagagccaagtattccataactgccattagccattctcaaaagtgtatttcctacctagttattgcataccaaagctctttcctaatgtaaagtgatttctgatacccccaaaagtaaaaaacatcagataacgcaatgcgaaacacaagacagccttagattttgagagggatctatccatttccaattcctgggatttcatgaggaaaacagatgttttttctcaaaatggggtctgtggtgctcctttttttcccaaggagtcccaggctgttagaacttaaatatctgcttttaattaagctgacttttaatggtactgctgtttttaaaaagtcctcttaaatttcttattacctgactttagccaggcgaaactgtcaataattctggcttttgaactttatcaaaggtaacctcccaggtgttcagagaaaggaaaattcaagacagaccattgaggggaagagaatcaacaaatgttcatgcgcatatcaaaccagaaaggactcattccctaagctgggaattgaaccctgaacctgggtcaccattgtgaaaagaaagcctcagctactgagctactcactgggcagtttccattgctcttcccagaaggagtctagagcagcagattttgagcttgcaaaggttttaaatgctcaagataattttgtagagctaactatgacatgaacccccaaattcctgttttctggatggtagagacctagagaaagtaccgccatgtggtcacaaggtcaagctcccaaggacataactagccagtttgctgggccgtcttgaacagtaggcttatggggtcctaagcttgtgttctatcctaaggtacccctctttctaacagaaatatacaggaagacaaattcacagtgcaaagtacaacagattcactgtagcttaaaactagcctcacaaatcctttttcacattaatcagaactttacagaggagataaacagtgatttttaccattctttgaactagtttgcacagagagaaagagagaggacagaagtctcactggtaagaaattcttacccttttgctggcatgccaggcttctgggttccctttccctgagcagtcctagtgacccagcttgacgcatcatagccctgggggccaagctgcaacacaaaggaaaattgtctttttttctgtcctggccagagcaaaatatgtgtgacatagacattagccactctgctcagcatccaatatcaaactaacaaggctcaaatttgcccctggttggaccctgtcatcattaatccaacctctgaccagaagtttcaacatgtggtctctgggcaagatggtcaccctgagtaagagaaaaggtaagaaagggaaaggagagaaagaaagaaaagcattggctgcatacagcagggtggggaaggcaaaataatcaaggataccagagaaagaccctcccattgcgcaaaagttcaggctgccgcttgaagggatctgtcatgaagggatcttttccagtagtcccattagctctcaaacatcccccttttgggaggaaaaagctccccaagtcccacattcacatgcatgcctaattatgtcacccacagccatcagcaaagagggcaaggcagattaacccaacgagaatagcagttaatatctcgtattgccaaacccattattagctgagagggactttactgagaggggcctgaaaccccctaaatcttaggaaggactctaaccttcttaagttgggccttgaatccatgttctgtcaagtgtccttgtcttttattaagaggggcctttaaccacctctgtcttaagagagactctaacgcccctaaattaggcctctaacccatttccatcctttacccaagcaaatgtaccccacttacccagagtcagccaataagtgctgaagtctatttcctttgggtcaggggagtctcctccgtgttgtcccttccatggttcaccagaaagatgttaccagaaagaggtccagatccagaccccaagagatacattaaaacaaagcaagttttccttttgaacttgtcaaaaattccatcttgtaaaggatattaaatgttgctttaagctgaaccttgagcaaattaggtggtttgtgtgaccatacatgtatgtggtggcttcttgtttgcaacttcaaggaacaagtattaatagttcagtgtatgatgttgatttgagttgagcatttgcagtttggataatcttaaattttgacagacactagctgtggagactctttctgttactaaatccttttgttttgaagctattgccattcgtctttctcttgtcctttatattttttgtctgtttctttaagcttttattggaaatgtgcataagtaaagaattacttgtgttacttgccaagcaatgcacatttcatagttttaaatctgtaatcagcaataaaaatcctaaaatatgtatctaagaacatcttaaaaaattctttctcactcaagaaagaattcaaggtgagtccatagagtaaagtgaaaccaagtttattaagaaagtaaaggaataaagaatggctactccgtgtagagcagcacccccaatgtctaaaaatcttaacaatgataataaaagcagaaaacatatggtaattttttggcataaaacccttactgcagtgagcattaaaaacaaataaactgctttggttcttcattctagagacatcatatttaaaaacttagatttcattatttgattttcattttgttacaaaataaaatattcttagtgtcacactaaacagagatcagataattaacctgaccccatgatgcataattttaattttaatttcaatttgagttcttaatagaaataatgaaaggctgttatcatattttggttgaatggacacagatctatttttttatggtaccacattgagaatttgtttttttacatatataaatctattaatggtattgtcaaaatactgtcttttttttttttttttaagatgtagtattgctttgtcgcccaggctggagtgcagtggcatgatcgtatcctagtgcagtctcaagtaatcctcctgtcatagcctactgcatagctgggagtacaggtgcacaccaccatgcctggctaatttttttttttttttttttgtagagatggttcttactatgttgtccagtccagtttgaagcaatcctcctacctcagccacccaaagcataggcatgaaccatcaagcccagctagtcttttaagctttgttgttttgaaaataatgaggattattactttgatatcatattagaattttttctaaaaatttaacaagaaattatctttagttctgtataatctgtgggcagctatatctatttataagcatctatgccaattattactttacttctagttgtaatttaaatttgttttagttttcaaggacacagctagtcttaataacttgatttgtttttatttccatttattgagtttagcatttataataacttaaaaaaaattttatttcactttaagttctgggatacttgtgcataacgtgaaagtttgttacataggtatatgcgtgccatggtgatttgctgcacctatcaacctgtcatctaggttttaagccccacatgccttaactgtttgtcctgatgctctctctcccctccccacacctgaaaggccctggtgtgtattgttcccctcccttcgtccatgtgttctcattgttcagctcccatttatgagtgagaacatgtggtgtttggttttctgtttctgtgttagtttgctaaggatgatggcttccagcttcatcagagtttctgcaaaagacatgatcttattcctttttatggctgcatagttttccttggtgtatatataccacattctctttatccagtctatcattgatgagaatttgggttggttccatgtctttgctattgtaaatagtgctgcagtaaacatatgtgtgcatgtgtctttctagtagaataatttatattcctttgggtatatgcccattaatgggattgctgggtcaaatagtatttctggttctgggtctttggggaatcaccacactgttttccataatggttcaactaatttacattcccaccaacagtgtaaaagtgttcctgtttctccacagtctcactagcgtgttgtttcttgactttttaataattgccactctgactgaaatgagatagtatctcatggttttgatttgcatttctctaatgatcagtgatgttaagctttttaaaaatgtttgttgactgcattaatgtcttcttttgagaagtgtctgttcatatcctttgcccactttttgatggggttgttttcttcttgtacatttgtttaagttccttgcagattctggatattagacctttgtcaggtggatgggttgcgaaaattttctcccattctgtaggttgcctactcaccctgatgatagtttcttctgttgtacaaaagctctttagtttaattagatcccatttggcaatttttgcttttgttgcaattgcttttggcatttttgacatgaaatctttgcctatgcctatgtcctgaatggtatcgcctaggttttcttctagggttttaatgattttgggttttgcaattaagtctttaatccatcttgagtcaatttttgtgtaaggtgtaaggaaaggttccagtttcagtattctgcataaggctagccagttttcccagcaccatttataaaatagggaatcttttccccattgcttgtttttgtacagcttgtcaaagatcagatggttgtagaagtgtggtgttatttctgaggtctctgacctgttccattggtctatatgtctgttttggtaccagtaccatgctgttttggttactgtagacttgtagtatagtttgaagacaggtagcatgatgcctccagctacgttctttttgcttaggattgtcttggctatatggactctttgttatttccatatgaaatttaaattagttttttctaattctgtgaagaaagtcaatggtagtttgatgggaataggactgaatctataaattactttgcgtggtgtggccattttcatgttattgattcttcctatccatgacgatggaatgtttttccatttgtttatttcttctcttatttccttgagcagtggtttgtagttctccttgaggagctccttcacgtcccttgttagctgtattcctaggtattttactctctttgtagcaattgtgaatgggagttcattcatgatttggttctctgcttgtctatttttggtgtatagaaatgcttgtgatctttgcacattgattttgtatcctgagactttgctgaagtcgtttatcagcttaaggaattttggggctgaaacaatggcgttttctaaatatagaatcatgtcgcctgcaaacagagacaatttgacttcctctcttcctgtttgaataccctttatttctttctcttgcctgattgccctggccagaacttccaatactatcttgaataggaatgatgaaagaagggatccttgtcttgtgccagttttcaaagggaatgcttccagcttttgcccattcagtataatattggctgtgggtttgtcataaatagctcttattattttgagatatgttccatcaatacctagtttattgagagttttaacaagaaggggtgttgaattttattgaagcccttttctacatctatcgagatgatcacgtgattttgtcattggttctgtttatgtgatagattacgtttattgattgtgtatgttgaaccacccttgcatcccagggatgaagccagcttggtcgtggtggataaggatatgctgctggatttggtttgtcagtattttattgaggattttcgtattagtgttcatcagggatgttggcctgaagttttccttcttttttttttttttgtcatgtctctgccaggttttttgtatcaggatgatgctggcctcataaaatgagttagggaggaattcctcgttttcaattttttggaatagtttcaaaaggaatggtaccagctcctctttgtacctctggtagaattcagctgtgaatctgtctagtcctgtgctttttttggttggtaggctattaattactgcctcaatttcagaactcattattcgtctattcagggattcgacttttcctggtttagccttgggaaggtttatgtgtccaggaatttatccatttcttctagattttctagtttatttgtgtagaggtatctatactattctctgatggtagtttgtatttctgtggggtcagtggtgttatcccctttgtcattttttatgtgtctatttgattcttctctcttttcttctttattagtctagctagcagtctattttgtttgtttgtttgtttgttttcaaaaaaaacagctcctggattcattgattttttgaagggtttttcgtgtctctctctccttcagttctgctctgatcttagttgtttcttgtcttttcctagatttttttatttgtttgctcttgcttctctagttcttttaattgtgacactagagtgtcaattcgagatctttctagctttctgatatgggtatttagtgctataaatttccctcttaacactgccttagctgtgttccagagattctggtatgttgtttctttgctctcattagtttcaaagaacttcttgatgtctgctttaatttcattatttacccaggagtcgttcaggagtaggttgttcaatttccatgtagttgtgtggttttgagtgagttttttaatcttaactctaatttgattgcattgtggtctgagaaactgttataatttcagttcttttgcatttgctgaggagtgtttactaataactttttaaaatatcagtgatttttccaggtaatagacatttatggctttgaaatttcaaagtatgtttaaacaaaaaaattcatcaacaacctcctcccacattctgcatttacatttatcattatcatgtgtgttcttatacttttattattagattgaaaaatatacaattgccattcttatagattaaaaatggtcaaacattggctatttcaaatagttcaatatgtaagtatctcaaaataatataacacatgctgttatctttatgttgttagtatttatgtaagtgctcatatatatatatgcacatatataaaaatacagagtatatcttcaatttgcctttttcataaataatttttctgagaattacccattttgatattttgttcattcattttagtttctctattagtattccactttataaaaaaaagtatggattatgtatttgtttccatgtggagagttagcttttctctttatataatttatagaagattgcaattaatattttgtatgtctccttgtgtgcatttgtgagaatttgcacagaaaaagcacagtgaaaggtatcataggcttcttaagtattcttatcttccattttgatatatcgccaaactgttatctaaagtggttgaaccaatttgccttcctatggcaacaggtaaaatacccatttgcctgtgttatcaacatgttttgttttccaacatttttgccaaaatcatgagtataaaatactcccttattttcgttttaattttaatttctttagtaactattaaaatattgaaacatatggcatttgagttttcgcctctgtgaattgcttgttctggtatatctttcattaaattttccattgcatttccttgtcagtaaaagttacacttataatctgcattttacatgttttaattatattgattgtaaaaatatttccttcagtggtttgacttttaaaattttttgtatttttggtctgtcacacaagagttttaaattttaacattggcgaatatatcagttactttttatggttcagatagttttatatcttacttaagaaattctcttttatcatgatatatattgccttctattttttctgaaattaatttttgtataatgtgtgaggtagagatttaattttaacttatctttattggcacattcttgtcccactgatttttattgaacacacattatttcctcactgatttttaaagccacctctactgtatctcaagctccaatttgatggtagtgtgtttaacatcttgtttcagaggtcaatttgattaacttcttgccaaaagctatagcacttgattatcttttgatatcttgcagtggattccttcttaccagccttcttcagctattgttaggtcttactcctccaaatgaattttaggatcagtttatataaaaatgtttattgagattttttattggaattgaattaaatttatacaacagcttagggataatttatattgttatgctgatttttttcatccatgatcatagtatatcattctatttatttagatcttcttttatgtcttttagtaaatttctataaataaaatactcataacttataataaaagggataaatataaaatttattcctaggtatctcaaggttttggtgctattgtaaatagtatcttttattaaattgcattttatatttattgctgatataaagaaatattataaattgttatatatcattcttatttccaacaccattttggaacacattaattcgaatatttgactatagatttatttgaattgttgaggtagaaaaccatgtaatttgcaaataatatatttatgtcattctaattcttatggattttacttcttttctttgtctgattgtgaggtctagacattcctttaacaatcttggaaaaaaaagcagtgagagcaagcatcctcaacttgtcattgctttaatggaaatggctttacattttttcctttaaataagatgtttgccatatcacgttaaaaactttcccacctattcctaattgtttagggttttctacttgtatattatgtatttttcaagacatggcagatttaatttgttgagatataattttcatgcctatgctaccaagtgagattggtcctgtcgttttcctttctcttaatgtccttgagaacatgtttcagctctcccatttatgacctgttttaccttgggcaaatttcttaatatctatatgcttcagtttcctcatctttaaaattagcatcaaaagaatatctttccatagtgtttttatgaggattaaataaaataatatacataaagcacacagaacagggcctgctactcagtatgcaatagttattagctgtcattgtcatcattaatattaagatattttaaaacacttttcccctaaaatacttagagtactttgatgcatatcctaagatctgtctctggctgctatttctggacatttctttgttgtaatatttctggtagctcttacttgtgactgtgaattgtagacatttgatgcccacagactattcagctctttcaacttctaccttgttcctaaggaaatctgaatcaattcatcagggtctttcctaaagaaatttgtcgaagttatccaatccaatgccacgattatatttcttcttgtatgattgtgtttttgttgtttgtcaaagaaatttttgcccaagtcaaggtcacaaagaattttcctgtaattttttctagctatattatagttttaggttagttctattatccatattgagttaaacttttacataaggtgcatgatatgttttcaggtgctttaaaaaacataagatatccaatattccaggaccgttcttggaaagaagagtattctttttccatttaattttctttgccacttagttaaaatacagtggactgtgtatgattttattatcagcattttcattgctactgaaatgcagtaggtatgcaattgattttcatgtattgatattgcaacttgcaactttgctgaactcatttataattcctaatagattttagtagatttcttagagttttctatgtacaagagatagttttacttctactttttcaatatggaaagatttatttcttctgcttgcctatttgccctgtctggtaactacagaaaaatgttgactagaagtggcaaaagtggacattgttatcttgttcctgatcttagggaaaaagcattttttcaccactaaatatgatgttagctgttggtttttcacagataccctttattagatgaggaagttgtcttctttaatagttagttgctttttaaaaattttatcatgaagtgttaactttgactatgtagctattaagatgatcatgacgtttttgtcctttatttttccaagtttgtgtattacttgattacttttcgtacattgaaccagccttgcatccttgtgataattccacttgctcatgatgtatgatcctttttgttagtactgtatttggttcactagaattttgttgaagacttttgcatctgtattcataaggcatattggcctatagttttcttttgatgtctttgatgtttttggtattagggtaatactggtttcatagagtaatttggagagtgtttcttcctcttctattttttggaagggcttgtgaagtaatggtgctacttcttctttaaatgtttggtagaattcgccaatgaaagcatctggtcctaagcttttctttgtggaaatttttaaaaaattactaatttgatctcttttagtggtatagatctattcagattgctaatttcttcttaagtcagtttacatagtttgtgtgtttcttggaatttgtctattttatctaggttgtctaatttttggcatacagttgttcatagtatcccttatgatccttttttgtgactgcaaagtcagttgtaatttcccttttttaattcctgattttaatcattagagtcatctcttttcttggctagtctagttgaatgtttgtcaaatttgttaataatttctaacaatcaacttttgttgtttttcttgttgtttttctattctctattttatttgtctgctcaaatctttataatttcctttcttctgctagctttaggttgagtttgtttttctttttctagtttcttaaggtagaagattaggttattgatttaataaatttctctttaaatataagtgtttacagctctaaatatcactttaaacactacttaaatcccataaagtgtgatatgttgcatgttcacttccattaatctcaaaggatttttaaatctttttgtaatttcttctttgatcattagttattaggaatgggttaattttcacacatttgttaattttacaaatttgcttctgttattgatttctaattttttctattgtgatccaagaatatactttgcatgatctcagttattttaaatttatagagacttgttttatggcctaacatataatctatcctggagaatgtaccatatgcacttgagaagagtttgtattctgttgttgttgggtggagtgttctgttggtgtctattaagtctaattggtttataaagtcattcaggtcttccatttctgtttgtattctgtgtagttgctctctccatgattgaaagtaggatattgaagtctccactattgttgttaaatggtgaatttttctctttaaatctttaaatttgtcattttactgttgttagacacatacatgattataattgttttattttcctgatggattgatatcttaaaatattcttgtctctactaaaaattttgtctaaagtctattttgtctgatgttagcataggagctcaagctctcttttggttattgtttacgtggtgtatctttcttttcattcttgaacattcaatctatttgtttcctcgaatgtagagtttgtctcttgcagaactcctatagggggtcatgtttgtttgtttttccattttgtaaatatctactttttgattgaagtgcttaagccatttacatttagcacagtgactgataaggtagttacaatgtcactttgctgttggttttttaaaatatgatttatgtcttctaaatttctctattctttcactgtcttctttgggttaaaaagttatcttctagtgtataatttaatacccttgtcatttattctactatgtttgttgcccaggatgttatcattaacatcttaattcataaaaatctaattcaaattaataccaacttaattttaagagtatgcaaaattttgcacctatatagtttttgttcactctgctttcttttgtgccgttattgtctatggagattttttacattggatgcccatcaacacagatatataattattgctttataaagtcatcttttaaaacaaatgtgagagagaaaaagaattacagtaaaaatacatttataatctttttaaatatttacctatttaattacctttacaggtactctttatttcttcatctggattacattgctctctaatatcctatcatatcagccagaaggacttcttttggtatttcttgtagagcaagtctgatagtgataaaacctctcaatatttctttatctggaaatgtcaatttatcctgcatttttgaaggagagttttgctagaaaaaatagtttttggtgtacagtttttttttacgactttaaatatgtcattcttctcccttctggacgccatggtttcttcacaagaaatctgtggttaatcttattgaagatcccatgtaggagatggccttttctcacttgctgctttcaagattttctctttgtctttgtctttcaacagtttgatttttaatgtgcctagggtgtggatctatttgaatttatcccacttgcagttcattgagcttcttggatgcatagattaatagttttcatcaaattttggaagtttttggtaattatttctctaaatattctttcagtccttttacctcttctctgaaactcccattatgcctatgctggtactcttgatggcgtcccacagctttctggggctttgttaatttctcaacattctttctctttctattgctcacactgaataatctcaattgacctgtattcaagttcattaattatttcttctgatcatttagatctgctagtgagctcctctagtgaatttttcatttgaaagttttctattttctatttattttttctttttttgatgaaatgaggtctcactacgtttcccagggtggtctcaaactgctgggctcgtgatcctcccacctcagcctcccaaagtgctgggattacaggcatgagccaccatgcctggctaaaaattttctatttcttttctcatattctatattgtctaaagcatcattgtcatactttgctttagttctttggacactttgttttgttttgtttttagttatttgaacatatataaaatagttgatttaaagtctttgtctggtaagtttaatgtatgagcttacaattgacccatttccattgcccatttttcttcccctgtatattgtttgtaggagtttctttgcatatgccatattctttgttgaaaaccagacattttaaacacatagtgtagcaaatctggaaatcagattatttccctttccagagttgttttgttgctgctatttgtcactattactactgtttgcttgtttagtggctttcctgagctaattctgtgaagtctgtttctttgtcatatgtgataaatgaagtcattgtttgctcatcttagtagtcaggcaatgactgaacagagaatttcttaaatgcctagaaccaatacattttccagtctctggtgagagatctgtacgcatgttgcagaatgccatcaacactgaggcagtttaacactctcctttagtccccacttcctgcttgtgcagagcctcaaagtcgagctgaggtgagaccttaggactttctcaggtctttctttagcatgcgcatatacctgagcacatacttagccttttgcatgttcataatcttgtagattcgcaggcattttttaaggatttgcaaagcgtttatggacatgatgtttcacatcttctccttttaagtattttggattgtttgttgtttcttctgactgttgttactgcctgggtcaactgcaatgttaagcagttgccagtgattatttttagcaaataattgttttaaacaaacagagtaaatgctgtttccagtggatgaactctgagtcaattcaagccttactagtggggctttccatggtacttccaggcagatcgaataatgacaatcatctgaggatagagctttgaaacagctccactcccattctgatcctctagcagtaactaggctgctggttttcaccctgattgcaaactgttcattttcagggcttccagagagtggcagagaggagtacgggaataggaaagctaaaatgccatagaacatgttgttcttaccaatattcagtcatttaaaaaataaacactgtccacattgttgcaagtctttgctttatttccagagttctcaataagttgatgtgatattctttgccagtgttcccattgcttttatggaagacagactcttccattgttttcactctgccattgctgatgtccttttattcgtttcctcaatgtcttatagtttttacctatatacattgccttgctttaatagatttataactaatatttcacattttcagtgctaataaaatagtatttaaaagttttaatttccattggttaatcactagtatatagaaattaaattattactcatttaacttctatcaaacaaaattaactaattcacttgttatttctaatagcttttatgtacagtcatggaaattttctgagtagataattatgctatctgcaaatgagagtttatttctttccttctgattgttgtgacatttgttacttagccttattatctgtttttaccctgatttatatgttggattacttagttttcccatttgactaattttgttgtgccacccagttgtaatgcataacaacttctttccagtcatcacctgtctattttctgactagacagctatgaggtctttcttgtatgagtcatgtctatttccttgatcaatttatataatttagacatatctttgccatatgaatatttttcaaagaagaatttttatggaatgtttatcccaatgaatatctgttgttaaaaaattggcaagtagcaaaggaataagtaaaatttatttctatggctgtccttgaaatatttgatagtattctcacctcaaatcataattcttttatttgggatggatgattcacattaactctaggtctttagaaaacttgctgtaactcttttttatgaagaatttcttcaaatatgaattctttagcaatggatatgattgcaagctccaaaatttaaaactaaaatggtttttaaaggttataaaacccagcccctttattttatagataataaaatagatttcattatccccctgcagcagagcttccctttagctattattaaaatatagggagtgaattctaatttatcagcattgaaaggtacacctccacttctaataccctggtctgactgccaacatttttcacacatatgactgtaatatcctcctaactggcctcttggcttctactcttatcttcctatattctagtctcagaacttttgaataatcctgagatcacatcactcctcttctcaaaaccctccaatggcttcccattttactcagaccagaaatcaaatttcttacagtaggctattagactttgtatatataacaatttgtacctccatcctcccctctcccccagccagctacttgtctgacctaaccttctaataacctccccccttttattctgctccaggatgctagctccttgcacctcctctaacatgccaagcatactgatttagaggtctatgtgcttattaatgcctgcctggaacattttgcccctagatatacgtatgactcattcccattcccctgtcaatgccacattctcaatgaggcctctcttggacataacatccccactaaaatctagccatgctctccaacctgctctaatccttctgtttttcataaaatgtattgcattctaatatactatatgaatttctcattcattatgtttatctacgtgaatgcaagctccataaaagcaagggtattttgttgttgttgttaactgattgtacttttggcactcgtgaaagtgcctggcacataataggcttccaataaatacttgtgaatgaatcaatacgtaaaagaatgaagccaccctgacatttaaagccatggttcaggctttagcaacatcacagtgttcatcagttttgctgtctttcagttatggtaagtctttcaaaattatgaatggctagcccctgtttgttatgatctgggttctttgagataaaacacttccctagaggttatataaaatattttagacaatattttatcctgagaaagcaaattggataacatgaaatgcaggtaatttctttttttctccttgatatctcattatgttggcaaaaataggaaatgaagactgtcagttttccacggctgccatgcaaaagtactgcaaactgggtggcttctcccagaaagagaatgcctaggactatagcggggcacagaaagttccccacaaggagtatttcaaagctgagacattaggggctgtatgaggcagaaaaattggaagcagaggcaaaatgggaaccttagggctgagagagcctgaaggttgtggggcattaaaaattcatgctgtagattaacagtgtggggtgtaaaggatgctaggagaggaagaactgagcatggttagggatagttgaaggtaaagaaaaaacgggacacaggcccagcttccttgacaacattatctcttacctcataaataaaatttatgctatgaggagtgactttcctattcgtctttcctattccccaaataaaagcataggcacacaatggctttgctgtatttgcatgtattcttctcatctttcttctaagaatgacatgtccatctttctaccattccctctttgtttaactttagatcctggatccaggtcaattgatcataaatcatgttgcctggatggccaattaactgaaagaatattttaccatgttttcttatttcttgtaactaattataaattttagaacaatttgtgttggaaatcttctaaagatttctgcaaagttttagtagatttagttttgtcttcataacaccacttggaggaataattctttgcacttgtgccagctgcctgttttaggatagatagagtagagaaactctccctacgggaaagtcagagcaggaggctgcctagagcacatcttcttgtgggcctcagctcatggggtatgtggaagactgagactaatgggtagaaagagagagcctataagtgtatttttcttagactacatcagctgagaatacactaatgaagaaatatttttatatgtaatattttggttattttctcaaatatattatttaatataaatataacatgtaaatatatgaatatacacaaatatatgcatacacacactcacacacagacacatactctttttaggctcctaagtctcacactttgcttgtgagtttcttcctgattctgagatcactatctcagactacttcgtgtgctaattctcctctccatgttttatttatcagccatatcctcactctgtcccagtttcctccaagcaaccaccaaggagcagcagaaaacataaatcaaacattctttaaaactctatcaagacagagtgaaaactgaatagttaaaagaaaaaacacattgggaaaatggtcatttgatgattaaaattgctccaattttatttttttagaactattgaaataaacaattattgaaataaattttgttattaaaaatataacaaaaaacttggagtcggtagtttttctgctttattctgtctccactctcttgggcttatttgtctcagtaagttctgaaaaaatatttgccaaacaaataaaataataccatgtggattaaggttgatagctacatttgccttgaaaggtcacctaattcaaagtagattggtctttgaacctggttttcttagaagattttccctgaggcaataaaattctgagagtgaactatgatactattgatatatgtgaatgacacagaacctacaagtaggaagtcttcgatgagtcctcatttggagattttctagaacagacattaatttaactttagagagaacccaaacagatagcctggagcttggagctataacaggtgggatgtgagagtgaggaatcttccttttggcattgcaaatactctggaaattgcaatcagaagcagatgacaatcaaatttagggctgatgagataatatatctatggagttataaactagagagaaatttgacttgggaagggacttctggagaaagccatgagttcgatcagtaaataggctggccaaagtattcactttgacttaagtcctacagtgtccatggagataactatgattatttttgttattaatgtggaattagcaaactagagattgatctgtaaaagtttcaaagggcagtgacataaatatctttttaaccttaacatcttcaaaggaatatcacttaaatacttgtcaggtattgcttggtaaacagagacttcttatattatgcacatgtgtgtatttgcaggtttagagcagtttgtcggaagaatgcaagattttcgattataccaagtggcacttacaaacaggtaagcagatgttgcattgtaaacctcaagaaccgaaaggataaatgctgaattcacttaaataagaatactatgtagattataccattttttatctttataccatttggcaaacttcacctaattaatgtttacagtgtttgctttggcttagtctatggttgttattcactagtgctactcttgaggaactccttgtaatatgaaattgatcacatttttcctaaggatattctgtaagaaaacttgatatttgaacattttataaaacttgggatacaatgcttaaattttctatatgaggtagtttctattaacaatacttgagaaacttctacatctgccttttttaaattggtttgttgactttatacctactagagaatgtagaacaataaacgtgattaattattttgatacatgggaaattctcaagagactgatctattagacttggagacaagaagaatgagcatttgaagtattgtgatatatttttctattttcagtgaacaaataattatatagactcaggctagctttaatgacattatttccttatcttgagagtagatgggaaatctttcttagggcttcttaaaagcacacagaattttaaaaaatttaagtgaaattctgcttaggatgcctttgaactttcttcttcagcttatgatatcatggtataatagtatattgttgtatggatgagttgatcttatttacttctattaaaaatcaaaaagaagaatgttcattcatatttcttcaaggcagatataaattagtgtggtgggtttccaaatgagaagactagcccttgtaaatttagaagcattgcttttgatgtggttcttagtccatggcagatcattaacaatataaacattctttcttaccaggctatataatcaaggtatgcctcagtaaagggtgccatggccctggaacacagtgttaggtgtatttactgccaaaagccttactatattttagatcacctttgtctaaaatgctgaagggcaatgttgtagtaattctttgggaataaagtttttccttgggagtgaaagattttatactggattctatactggtagcttttggtcccattcaaaacttggtatcagttgaaaagaattgatgagatttaaagaaggtatgacttcatgtgatttaatgaatggaaaagctgcctgactccttcactgctccactggggtctgagaggaaaagcctggtttctctggtaagaccttgattactaattttggcctacctgaaatgtctgggaaggtgctatgtggaagaatgcctataaatagaatgactaattctggtctagaacaagtatattgcccctaatggaaaaattaaatatatctacctggaattggcattctttgactgttggcagccgccatatgatctgaagccaatgaagcattacaggatgtcaggatctgtactgatgagtcacaggaaaccattgacaaatggccttggcctcagtccttcacttaaaacagaagcagataaaatgatacttgctttcgtacttctttcccatggatgaactgaaaacattatctataactctcattgttctccatatattattgttcactctcagtagttagtttagcatcctaagtaaatgtgatcatttctatattatcacaaatagacacggtaaaatattgtggtatttaaataagtatcttaataatcagacaagggcttatgcatgcttcttgatataaataaaaagttaatattaaaatgtgtgggttttgatatacattttatgataatgaatttgtttatttggccaaaaataagttttattttatgtttcatgcatcaaattattaaaactaaatggatactcatgaaagcactaaacgagtgacattcatttgtaacgactcctagaagttctattactgttaagctctttgtccttacagtctccctcttgactcccacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtaatgagaaacgataaggtgtacattaatttcctgtggttattgcaacaaatgcccacaaacttcatgtcttaaaacaacagaaatatattccctaacagttctggagatcagaaatatgaaatcaacatgttggcagggctacattcccttaaagattccagaggaggatccctccttgccatttgcagctcctggtggcccttggtgttacttggcttgtggcaccacaacttcaatctctgcctccattttcacatggtgtccttccttgtttctctgtgagcatcaattatcccttttctttctcttatataaggcccaccctattagacccaggatgatctcatattgacatccttaattatactgcaaagaccctatttacaaataaagtcacatttacaggtttggacagtagtacttggacatatctatttgggaacacaattcaacccactacaaggtgaaaactgaactaggcaattgaaccttgcctcaataaagtagtgtattataatgtatacaataaaaatatctaaaagacaacatgtaggaccttatgtttgagatttgtatcaaaatgatatttatgaaatgttgaaaataattatttttattaagtagcaaaaattaatacaaactaaggtgctttttctaaattaagaagtctctatatatgacatttatttcatagaagtaatgttctttgtttatgtctttatttgcatgttgatttataaaatccttgagcaaatgaacagatacacaattatagaatatgttgcttttaccacagggctatgaagtttctggatgtctaatacatatttgataactataattatgatgaagtgagccaatatatttgaatctaataattccatggtttgatatatactgatggttaaacttaaaactttaattacattaattaactttccattttcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaagtatgaatatttttaaacaattaatttaatagactgattggttattaataatgtacaagtatgctagctctctaggctggtggagacttcccttcaccaccaacttccttgaggcagattctcctaagtcttatccctaaattgggcttaaaactatgtttaaagttcttgtaaaagacattagagtgactcttatttcaatctcactgatgtttcacaatctgattttcagattgtttggcaagttatctatgtaaatagaattttcattatgttttcaaggaactgttttagtgtggctttctatgataatcctgtattgtttatatatgaaatatatggaatatgcttttcctagaatgaataatttaagcttttattgatactgtgtagtaatttctcaacattttgatttctgttttgccaaaaatgtgaatagattttcatgacatcgaatttctttcattaacagttttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggaggtattattatgaattttgttttcaacaaggtttttgtcatacttactgtcttaacagcacattaagatgtcagagcaagccagatttcaagctttacattttgaaatgatttcatactctaagattttaggggaagatctgtatgtgagtcttttctctatataacattgttatatatatatatatatatatatataaaacgtattttataaataaatatatatatatttatatatacaggaattgattttcaaaagctgttgcttttagaagctatgatactctgaatctgacttagaagtgatttatccaatattttacttgatttgttctggaatataattttcaaatattctcaaaagcaaagagatggagctgaatttggagttgtaactatagcaccagagagtttttaagtacagatcttgatctacctgagttcatagtgcacagttccatgggtaatacttgtttttctttagtggaaagatctgatatgccctaagtagtttataaatgtctgatcataattgagaacatgactcacaatatttaaaaagaaatgacagctgcaaacctaggcagcatactgtctaatatagaaatgtacatatagagtatatttagaatggattgttctggaggaatgataggccttgtgaataaaatatgtctttaaaagcagaccaaaataccagtatataagcattgtttgtttgctaagtcatagcataatgaacaaagcaatactattaaatattcatcatctaactttggaaaaaaaaataaaaaaattgaaatatgttaactgcattctgcagtttattgtcaactttatattcttttttctttcttttttttttttttttgacaggcttttgctctgtcacccaggctggcatgcaatggcatgatcatggctcgttgcaacctcgacttctgggcctcaagtgatcctctcatctcagcctccaaagtaactgggactacaggcatgtgccaccatgcccagctgattttttttttcactttttgtagagatggggttttgccatgttgctcaggctgctctcaaactcctgacctcaagtgatctacccgcctgagtctcccaacatgctgagattacaggcgtgagccaccgtgctcagcctgaactttatattcttaactgtattttaaatagtgtagtaaatgccttcccttggtacgtggttggtatagatataaaaaattccatttccctttagaggttggcttgaaaattatctttacaatacacgggtttggatattggtgacagtccttctgacatttccagataaattaaaaacgtgtatggatatccacacgattaaggagaaactgattttgtatcaattaaatatacaaaaatcttccctgttaaattcacataatgcatatagtcctaggaccttaaatatattcacagttgagttggtgttccttaggagtgtgtgatgctcatgtttgcagatgtcagtgccatggtcatgccgataactgcgacacaacaagccagccatatagatgcctctgctcccaggagagcttcactgaaggacttcatgtgagttctattttatgcatggaaatctaaaaaaaaaatagtagagatggtgactataaattctatgaacttaatcttggcctaacaaatgaaaataaatttaaaaactgatatgaacttaaaatgtcaattattgcagattttttaagaaaaataacagccatcaattaagttgaaattgtagtttttaaaaataatttcagccagagaaattacaactgaaaccaaaccctaaggttcttttctcttttgtttttctttctttgtttcatcagcattatcatgttttataaaacaatttttaatgtgtttggatagcatggcactaaacaaaaaatagtttgattcttactaaagggtatttatacaaaagtatcaataaacaaaagcatcgttagatgaagaacaatgtttatgtatttatgtcaatcaaggttcatttattgctaatatcaggcattttaattaattgaaaatctatagtaaaatgatttatgagttatgttactttagttttctgtgacgatcaggggaattccatagttgaggtggaattttagcttcatctttagggaaaagaggtaagtggaaataaaatcaagaaacattcgttggtaggaatatctagcaacaacatcagaaatagctgatatgaaagacggttcagcagcagtaacaattataccaataatgagagtagataatatagactcttcagtaaatatgtttaagacaactggctgctaatttgcaagaaaataaaattagagctctactgattgtatgtacaaaaatgtatgtggcttaaacttttagtgaaaaataactataaatatattaaaataaagattagaattctatatcttaagttgagggcttttatcagctaagcaaatgaaatacaaacagaaacaaacatctggagctatgaaggaaattaatgacatattctgttatataaatatttaaaattctacacagtataagggttaacataaatgtaaggtagtgataaatgatggattgatagaaaatatttgcatcatgttaacaggtaaagagttaagattcctaacacacaaacatttacaaaatattaagaaaaatataacagtctgataaaaatgagcaaatatatgaacaagcaatttacaaatgaacaaattgtaactttaataaacatataaaagattacccaacctcagttttaatcatattcaacaattgtttttaacatttcaaattagcagaaaatataaagattggtaatatttagtacttgtgggaatataacctttaacacatcactgatgggattgccaattgacacaatagttttggggaaaatttgtccacctctactaaaattaaattttcaaatatagtgaactacattatataattgctgtcattctgaaaagcagttcttcaatgacaagtgtatggaatggtgtattagtctgtttgcattgctgtacaggaagacctgagactaggtaaatataaagaaaagaggtttatttggcttgtggtactgcaggctatacaagcttggtgccagcatctgcttggtttctggtgaggcctcagaaagcttacaatcatggcagaaggcaaagccagaagccagcctcttttaaacagccgtgtctaaacagccatgaactaacagagtgaggtctcactgctgaagggaaggcacttcatgaaggatccacctccataacccaaacatctcccaccaggctcacctccaacactggggatcacatttcaacatgagatttggaggggacaaacatacaaactatataaaatgcttatatttctatcattttgttacataaatatgggcttatatgttagtgcattttagcttttcagatggtagcactgtctcatacactcatgtatgacttgtgaacatctctgcctcttggaccttgccctacacttgtgttttagttagttacttcacttctctgtgaaatttattttaggatattatagagcatcttgctttttaaaaaaccatctgtaaaggttttggcaaattccatttctgtcttctgattcttactctgatctaatttgcttttgactgtaacattagtgagaatagttcaatggtaagaatattatctataatgcagactttctctagcacattcaaaacgtagtcccactcctcagtttcaactaagagtctttgatttagttatggcctactttctttctttctttctatgtgctcagaccaaaactttcatgttctaatttagatattcttttgaatttattttctagatcactactttatatacatctagtcctcaccattagtcaatacttgctttaaaagaagaaatcttttatggttttcttttggatttctaatgcctagagtctttgcatttgatttcattagtatattatgaggaaaaatcttttagaagaactgattttaatatgcttgattgtatggcttatcatattgtcacagaaatgaaattaattggattaacttgattgatttattcttcactgagccataattgtgtgtttaaatttttgccaattttatttgttctagattttaaagttaaagcaacatttattatatttttctactgtcttcttttgatcccttaagatggacacttacttccttataatcagtgatttctttcattaaccttgtcctctcctccacaaagccactaacaccccaattaaaaaatgctttgggatgaatttagcagggcaccttgaactgaatatgtctagtatttgcaagctacagtttggctaataccttcatatgatatgttcttttctgagcttctcttgctttctgttgactagtcagtcggtattagtctctctcatttgcttgtgacgtcctgtcttgttttatctttctgtctttaattgctcacagttaagtgttggatattttctgattcttggatgatttcatgcttccccttaaaaatagagccattaaatgaatgaaggctcatgattggtttcagaagacaagttgggattttcagacttggtctcaggtggtgaatgttggattatgaactagtgaattaattaactataatttgggttgagaatacattttaatgcttcttatttagaccttaagtaccttttgaaaacaaaaatgaaaaactaaactttttttgttattttcctccttgacatattttgatagtttatgaatttagccataaattttaaaaagcaacaaatataatttacttagcaaactttggcaaatgcaaatgcagctgcagggaaaaagtcaatagactgttaagttgaatgatttctcagtcctatgatattttcaataatgtgttgaaaatgaaaaatgattttatagaaacattcataggcatgacattctcctttgttaccattcaaagtattttaatacaagtagagacttacatatctgagaaaagtcgtcttacggtaatttgaaaatatacctattctaatgcttttcttgttgttctactttttaaaattatacgttttaatataagccattcacttcctattgggatccatgttctttttaagacctggacataatccaaaaagaatgtcttcaattccacagtgttatgctatccattaataatattacttaataaacagggcttttgtgaattatattacagacatttggcaaacagatgaaaatgtaaggactgaaaatatgccaattcttggcaattgtctttcctatgagaaagtgtttttagtagaaacaaaaatgaatgaagttgagaaaaggtgaatggtgaattcaggggcaggttcacatatttagccatcctaaggaattttccgtacaaaatactattcatttgtttataaggtcaatgtcacaaattggtggctcacaggtagaaacagtgtttaaacagttttaatttaattttctgcaagagttttcactttaaaatatttatttattcttcaatcttttttatttatttatttttttgagagggagtctcactctgtcaccgaggctggagtgcagtggcatgatcttggctcactgcaacctcagcctctcagcttcaagcaattcttctgcctcagtctcccaagtagctgggactacagctgcacaccaccacacgcggctaactttttgtatttttttttttgtagagatgggtttcaccttgttggccaggcaggtcttgaactcctgacctcaagtgctccacctgcctcggactcccaaagtgctgggattacaggcatgagccaccactcctggccctcaacttttattttaagttcagaggaacatgtgtaggatgtgcaggtttgttacttaggtaaaggtgtgccatggtggcttgttgcatagatcatcccctcacctaggtattaagtccagaaaccattagctattcctcctgatgctcttccccccacagcccccaccatccctaagaggccccaatgtgtgttgttccccgacatgtgtccatgtgttctcataattcggatcccacttgtaagtgagaatacgtaatgtttgattttttgtaccggcattattttgctgagaataatgacttccaactctattcatgtccctgcaaatgatttatatttctggtaatacacagtaatgggattgctgggtcaaatggtatttctgcctctagatctttgaggaatttccacactgtcttccacaatggttgaactatttatactcccaccaacagtgtaaaggtgttcccttttctccacaaccttggagcttctgcacagcaaaagaaactatggtcagagtgaacagacaacctatagaaggggagaatatttttgcattctatccatctgacaaaggtataatatccagagtctagaaggaacttaaacaaatttacaagaagaaaacaaccccattaaaaactgggcaaagaaccctgagttagcgagttgttgccaggggaggacattaatgtcttcttttgagaactgtctgttcatgttcattgcccaatttttaatggggttgtttgtttgagaacagttctcaaaagaagacatatgtgtggccaacaaacgtatgaaaaaaagctcagcatcactgatcattagagaaatgcatatcaaaaccacaatgagataccagctcatgccagtcagaatggcgattattaaaagttaaaaaatgacacaaatttttaattcctcacttctcttaatcagaacatagtctaacactgtgtccatttcctgccatcaacaactcactgattcagggtgacatttaccacatttacaacagtatcactcttgggcttgctacaacattcactactatgtatatccttatacatgggcgacatcactttggtgaactacctggccttgaaagactcggagcttcttaacctcctaaagcaaaactgatggatagattgagacactagaagctagaatacatttttaattattctgagtagagaaagaccagctgttcattgctatattcattgttaactcctatttcttttacccctttataaaaataaaaactcacaaataaccgaaaacaactcaagaaaatctattagcaaagacactgtttactctgagatgaaattaaagccatgcttactttttttttaattacatttttgacatctaaaaacatttaccttggggagcctcactgattctcctctgcactctttgaccaggaactccgatacatttttgtattgtactggcaattttaaggccttgactttaatgtatgatacataccataaatacttcactcatagagaatacttttagaatacttgtcgcatttctttccaagaatgaaaaaaaagcagtaaatgcttaatttactaggctcactttagaactgatttagggtgaaacaaatccaaaagcctagatgctattcattaactttcatacaaagttaaatatttcaaagtagaaattagaaatacatggtattgaacttgcatgaatcattatatatctcacaagttacaaacatgttatttataaatgtttaatttcatttgaataaaaaatagccactgttacttgcatttttaagtaaacttttaattttgagataattatagatttatatacagttgtaaaaaataatataaagacaatttgtgtactctaccaatttgtcccatggtaacatctggcaaaactagtgtttttttctttttacatcaaaagtgtgatttgtgtacaataaaatatacccacttaaaaatatatagtttgatgagttttggcatatgtgtaccctgtgtaatcaccatccctgtctagagatggaatgtttcactctcccaaacgttctcttatgcttctttgcagtcagtgctgtctctgaacccccaatcccaggaaaccaccaatcttatttctatcaatacagattagttttgcctgttccaaaatttcttagcatagtgttatttggtatgtaatattttcgtacataggcttttaaatcccacctcacccccacttttagatcattccctaattacatgtgctgttagctttactgcaacatggtatctctggcccacttaatcagaaatccattataagtatcaaagtgtatatattaagctcataggtacataatacaagctaggaattggaagcctgggtttatctgtcaactaacatatttgcaaagctataatatatttattacttctttttcttatctagtactttctttacttgatctaagagttcaagtgttgaatagaatctagttttaagaaaagtgttgtcagttgaaacttgaatccttatgagttgtctttttcctttaataactacatttacctttcggggctctggccaagagtgatgcaatgatcagtgtctcagccaagcattggcacttcattggctacttagctattctttcgtcattttgtgacatcattacctgcaagggtagccaagccttcacagagcaatttattagtaaccatgaacacttcttattctttggctctaacttatgacccttttataacattaatcatagatcttatgaattaactacaatcaaactatcagtataaatttttgttagcattataaatagcacagccagcttgaaactttttatataataagccttcctaccactcaataatttgaatggtgccaacatcacactctagaatgcttattatataaatgaatatttctgttatttttgaaagattcctttagagcaccaaagtccaaaagtatgaatcatcatgactaatttgtgtcatatttatattatatatcaggctttaccactgcttattttttctctgtttgttcgcagattttaccctaaatatattttatttatattttaattattgtaatgctagtaaattaattcatttttatataactagcattcacacagttcatattataggatctacatttgatatatgtttagtaagtcaaggtaaagaattttctttcctcactgacatgatgatattattaatctttgaaaaacacttgtactagttctttccgtgagataggtatgtgcataaatgcttttaaaatataagttgaaaacatgaaaaagaggttatgagcatggagataaattaagacagccttacagaagaagcaaatagagatagtgaaagtataaacatagtaaaagaaaagataatatttgaagggataagagtaaagaattatctaaaggtgaggaatgacatgatttttctgaatcccaagtaggctaagaaaagtaaatgcatacataggtataatataatgaatccaataatcaccaaagaccaagcagccagaaagacagaaatctgataatcaccaaagacagaacagcatcctaaaaacagccagagagaaaaatacaaagtgtaagaaattaatttctaagacactactgatatatttctcaacagccacaatgaaagccagaagacagcagagtagtgcctttgaaatgcagagagaaggcaaccaagaaatatggaattgtatttgtagtagtaccatcaattagaaacaagaaagaaagaatgcatttttagtttacagatatatatatcaatattatcaccagcagactctcaataaaagaatttttcgagaatacttttcataaggatatataatgtttccagaaaataggcctggtgtgaaggaaggaattgtgagcaagtaaaccagcaaatatgtggataaatatagaggaaaatttactgcgttaaataaaaataaggttatatgtaagaaagagtataaaaagtagcaggataccattaaatggtcattaaaaatagcatttaaagggaaggggtaaactccaacttcagctccctctagccattctgttgcaccttggggtaagaagagcagttactgagaaatacttgtaaagttcacagccaatgagcacagggctcattaaaaactgaaaactaatcctagaatcatagaacaggggtccccaacccctgggccactggtcagtagtggtctgtggtctattagaaaccggactgcatagtaggacgtgagcagctggtgagctatcattacttcctgagctctgcctcctgtcagatcagcagtgacatgaagttgtcataggagcataaaccccattgtgaactgtacatgtgagggatttaggttgtgcactccttctgagaattcctgatgctttgaggtggaataccttcatcttgaaaccattccccatgtgctgccctcacacccagttcgtggaaaagttgtcttccacaaaaccgatccctggtgccaaaaatattggggaccactgccatagaacgctttccctcccctctcatcttaccaccacaccatgaaaggcctgtttgccagagttccctttactcagtacatcatgtctggatttcaacaaaaagttacaaagcacactaaaacaccaaaaacaaacaaacaaagaaacaaacaaacaacctcacagtttgaagagagagagcaaaaatgagaatgagactcagacatggaaaggatatggaaattatcagaccagaaacttaaagcggctctgatgaatacactaaaggctctaatggaaaaagtagacaacatgcaaaaatagatggcaatataagctgaaagataaaaattctgacaaagaagcaaaaagaaaagctagagatcagaaacactttcatagaaataaagaatgcctttaattggatcattaatatttggggacagctgataaaagaatctgagtttgaagatgtgtcaatagagactaccaaaatagaaaggtaaaaagaaaaatgactgaacaaatagagcagaatatctaagaactgtgagacagctaccaaaaatgtaaatacatataatggggaagaagaagaagaagagaaaggaacagaagaaatatttggaacaataatgactaagaatttttcatattccaaatgcagaaaaatcaaagttagggaaaaatatcttaaaaggagcctggctgaagggggaacatctagcctatgaaaaagcaaagataagaattacattctacttctcctcagaaagcatgcaagcaagaaaagtggttaaatagttaggtgttgacagaaaaaaaaaaatccacctagaattctgtatcttgcaaaattatcctttaaaagtaaaggaaaaatactttctcaaacaaaaaccagtagacttttcttgccttgcaagaatgttaaaggaagaacttcagagagagagaaaaaatgatacaggtcagaaaactcagatttatgtaaagaaagggagaacattagagaaagaataaataaaataacttttatttttcttatccttaattgatctagtagataccagtttgttcaaaattataataagaacaatgtatttcattattatagcatgtgtgtaagtgaaatgaatgatagcaacaatacaagacaccagagggaggaactaggaatactttattattattaggtactcatgccaccttttaagtggtatcgtgttatttaaaagtcaacttggaactctcgcatgacattattttgtcttgatagttcaagctccacctgcggttctcccgtcctccatgccaggtgtcaggggctgctctggatgttaactcttccgccccatgacttccagttccaaaatggcggcacagaaacaagctgccatgccacaaccccaccgcgcccctctcccgccaaaaagaaaaattaacaaatatacattgctgagattatcaccagaaattgtcacgatagtccagaactcaaatatgaagatataactgttcccagggccataaggaaatgagaaacaccaagtggatggtaagaaacctgactttcacatttgtagcactcgttaccccattttgcctgacaccaaatatgcagaagattttcctccaactcacttttttctacactggaaaaattaagattgaggtaaacaaccagcttccccagccattctgggttaccggaaagagacctgtcctatccatgcctcaacccactggaagcgtcatgagtgcctaaagggagacatattcctgaagataggcagagacaaagggggatgtaggtctgtcatccccagcctgggaaagtctgctctgtaacttgaccaatgcagacacaatgtcagagtagctgcttagcagcactatgatgcaggaggattatttcactgttctcctcggcacaaacccttaggcagccttcccatactgtcaggatattccctttgggacctctcttgttaagaagggcacaattggattgtttactgaagccaaggcgaacctgggcttaaagcgccccctatagctccctagaggaagcaatttagcagcaaagacatagatgtatgtccacaagaaaaacagcagtaggaaactatgatgtctccaaacagacaaagcagggaaccagggactggccctaacaagacagtaatatgtaagctccctgaccacgaattttaaaatgcagttttaagaaaactcagtgatctccagtagaacacagaaaaataattcagaaattcattagagaaatttaacagagattgaaattttaaaaaatctatcagaaaccttggaactgagaaataaatttaccgaactgaaaaattcactagtagctctcaccatcagaatggattgagcagaggaaagaatcagtgagcttgaagacagaatatttgaaaatatatggtcgaggagaaaaaaagaacacaaagaaatgaagatttcctacaatatatagaaaattattaatacctcaaaaggccaaatgtaagaattaatggtattcaagagggagttgaagaggaaggattagaaatcttattcaacaaaataataacaaaaaattccaaaatttaaaagtatacttggattagttataaatgtatattataagctttatagggcaacccccaaaaaagttttaaaaaggtatagttgatatatttaatacttacaaaggaaagaaaatggaaccatgtaaaaatgctcaactaaaaccacaaaaggtaaaaagtatatagaaaacaagaatagaaacaaagaacaagggcaatgaataaaaagtagtagatattaatccaactatgccagtaactactttgagtgtcaatggtctaaatataccaattaaaagagagagattgttagaatgaattgaagaataaaaccagctcattttataatgccaacattaccctgtaccaacatcagacaaagaaattacaagaaaagaaaaccacagaccaataactctcataaaaatagatgcaaaaattctcaacaaaatattcaaaataaaactattaagcaatgtgtaaaaataattatatatcagaaccaagagggatttatctcaggtttgcaagactggttcagcattcaaaaatcagctaaagtaattcctcacatcaacaggctaaaggggaaaaattacaagattatatcaataaatgtagaaaaagtatttgacaaaatcaagcatccattcatgatcaaaactctccacaaataaggagtagaggagaacatactcaacttaatagaaaatatgtataaaaacctagagtgaacatcatacttaaggataagaaaccagaatctttcctactaagatcaggaataagacaagaatgtttcctctcagcactccttttcaacaacgtattaggaaggaataaaaacaacaacctcatttcaaaataaggcagtaaaggagaacgaaagaaaaaggatatatagaaaatagaaattccaaataaataaacaatcacaacaaatctaaatgtgctgaacatattagaattatgagactgtctggctgaaagagaaaacaacatccacctattgtctgagcagaggctgaattagggcaagagaatgtcttaatcacaaactttacaaaagcaccaaaaacaccctattaagcaagatctataatatttttatgttatatttcaaaaagtcaaatgatttagaaatgtataattaaaaatcaaaattttaagtaaagacacattagtgttgcttgttttatggtcctgtgttattttgtaatgggagctgttgtttctaatcagtccataattcctacctaccagttttataaggttggcatgtacctgtctcatagaaggttttacaatcgtctagaaacagactaggcatgatgggacattatacacagctatttttttaaaactgtagagtgtttattaactttttccatttggctccaaagattggtaaatattttctagttgtatacagaggttcgtatttttcctttgccctcatgctgcaatgcagctcagcatggtacttgtgctgagggtgtgagagacatactcaaaaaacaagcacacttcaagtttgaaaatttaagaaagctagcatgagctacataaatattaggcaaaacagacattactgtttcattaaagaaaaagaggcttattgtataattataaagtataaaattctaagtttacatgcatctcataatatagtttcaaaagtataaagcagaattttatagaaccagaaagagaaattggcaagttctaccatcagcatagaagaatttaatacatctcttattaaaaatgtctttttataaaaagaaagaaaagctacatactagcagttgtcattagcaagacaacacatatataactgacaaaggtaacatttaaattaagcaaactatttgaaaaacagacaaaagaagtgaacaagtaattcacagaagaagccagaagtggcaactgaaatggtcaatatacatgtaaagacatgtgcaactttactggttatcagtaaactaaaaaaaaagaatgtgataatattttatactcatcaagttgtcaaagatggcaaaatctggaaatttcaggaactggtaagtggggactcatacaccacttatgggaaggtgctgctgcactatggaaaacaatttgcaaatgtctacgtggaacactttacagtagtggatatgaaggaatatagctatcacatcaacatgaccagacttctcaaacaatcatactacagaaagcttgttttagaataatacatacactgtatacacttatataaattttaaaatcatacaaatagaaagaagaaactgataaaaggataggaggcaggactaacttgcagctccccctcggacagacagagcagcatgtgaagacacacatcatgaacttttctccaagaactactgcagcaacataccaggaaagccacgagaatccacagatcctttgaaggaaatagattgctgctgcaggctccaggagacagccgaaaaactgtaagtgcccaaagtgtgaaagggggatcttccacccctgaacacatagccttcctggggaacctgaaggtccaggtcacaggtgatggatttggccttacctggagctgagacaaacttagagagctgaacaaaatataagggtaaaggaagcagggggaagagccctgtggactctctcagcccccaggaaaaccatttctgactttgtctcctagggtccttgggtaggactgccagtggaagtggggaaagaccacaaggagaaggaaacttccagatgaactctgtaacaatttcgactgaatgccaactttcctagcagaatctgggggtgagggtgaactgggagtgcagacacagcacagaagttgcatcaggcagggaggtgtgaaacctgaaacccctgcttgcttttccagtggggagacctggagcaggggcaagtcctcagccctgttcacccattgcctggaaataaactcagtgctgttgtggagagtattgtgggagtgagactggccttttgggttgcatgggagctgggtgaggcctttcactgccagctttcccctactttcctggtgacctgtatgatgtagcagaggcagccataatccccctagaaacataactccatcgccctgagaaccacacccccaacactcagagcagcttcagcaaggcctgcccaaggagagtctaagctcagacacacctaaccctgaccctacctgatggcctttctctacctgccctcgtagccagacaaaggacataatctcttgagagctctatggccctgaccaccgcctgagaaacttatccaggagactctagagcaagcttgtatcctccctatgctactgccgttgatgctctcttgaaagcgccacctcctgtctgaaggccaaccaacacaaaactagtgcaataaacaaaaatacaacaaaggaccctcacagagtctacttcactcccctgctatctccaccagagcaggtgctggtatccagggctaagagacctgaagactgatcatatcacagggctgtttgcagttactccccactaccagtctggaggctgctagctccactgggtggctagatccagaagagaaacaacaatcactgcagttcagctctcaggaaggcacatcctggagcacccacatccagggagcacccacatctagggaacacccacatctggggagcaccctgtgggaagaaagaatctgaacaacagcacttgagccccagatcttccctctgacatagtctaaccaaatgaaaagcaacctgaaaaacagttctagtaatatgacaaaacaaggttctttattatccccaaaagatcacaatagcttaccagcaatggatctaaaccaagaagaaaactctgaattcccagaaaaagaactcagaaggttgattattaagtgactgaaggaggcaccaaaggtgaatatgaactcaaaggaatttcaaaaatgttacaggatatgaacagaaaaatctccagataaataaatagcataaataagaagcaatcataatttctggaaattaaggacacacttagaaaaatgcaaaatacactggaaagtcttagcaatagaatccaacaagtagaaggaagaacaccagagcttgaagacaaggcttttgaattaacccaatcaaacaaagacaaagaaaaaaaaaaattaaatgaacaaggcctccaagaagtttgggattatgttaaacgaccaaatctaagaataattggtgttcccaaggaagaagagaaatctaaacgtttggaaaatctatttgagggaataatcaaggaaaacgtccccaaccttgctagagatctagatatccaaatacaagaagctgaaagaacacctgggaaattcatcacaaaaaggtcattgccaaggcacatagtcatcaagttatctaaagtcaagatgaaggaaggaatcttaagagctgtgaggcaaaagcatcaggtaacctatgaaggaaaacctgtcagattaacagcagatttctcagcagaaaccctgcaagctagaaggaattggtgtcctatccttatcctccttaaacaaaacagttattggccaggaattttgtatccagtgaaattaagcttcctaaatgaaggaaaaatacagtctttttccgacaaacaaatgtttagagaacttatcaccaccaagctagcactacaagaactgctaaaagcagctctaaattttgaaacaaatccttgaaatacaccagaatacaacctccttaaagcataaatctcacaggacctataaaaaaaaaacacaatttaaaaaaaagcattcaggcaacaaatagcatgatgaatagaaaggcatctcacatcctaacactaacattgaatgtaaatggcctaaatgcaccacttaaaagatacagaatggcagaaaggataagaactcaccaagcaagtatctgctgtcctcaagagactcatctaacacataaggactcacataaacttaaggtaaagaggtggaaaaagatattccacgaaaatggacaccaaaagcaaacagcagtagctattcttatatcagacaaaacaaacttcaaagcaacagcagttaacaaagagggacattatataatgataaaaggactagtccaacagggaaacatcacaattctaaatatatatgcacctaactccagagctcccagatttagaaaacaattactactaaacctaagaaatgagataaacagcaacacaataatggtgggggacttcagtactccactgacagcactagacagatcatcaagacagaaagtcaacaaagaaacagtggacttaaactatgacttagaacaaatgtacttaacagatatttacagaacattctacccaacaactgcagaatatacattattcatcagcaggtgaaacatcctccaagatacaccatgtgataggccacaaaacaagtctcaatacatttaagaaaactgaaattatatcaagtactctctcagaccaccgtgaaataaaattggaaatcgactcaaaaaggaaccctcaaaaccatgcaaatacatagaaattaaataacctgcttctcaatgattcttgggtcaacaatgaaatcaagatggaaattaaaaaagtcctttaactgaattgtttgatatagtgacacaacctatcaaaacctccatgatacagcaaaggtggtgctaacaggaaagttcatagcattaaatgcctatatcaaaaagtctgaaagagcacaaatagacaatctaaggtcacacctcaaggaactagagaaacaaaaaccaaacccactcttattgacttaataaggaaattaaaaaaagtatgctgagattgctaagatctattataataatgaatcttctatctgtgaaatagtgaaaaaaaaagaaattagtgctagatttgctgtcaaaccacaaagtgcaaaagttacggccgcagtgctagataagtgcctagttcagattgaaaaagcattaaatttgtgactggaagacatgaacagaaaatatgtactatatggaaccaaaatatgtactacatagtacacatagtaccaaacccagttgctgtcacttggcacatagagatctggcatctactggaggtcttcaaatgtattccttgtggaaaacaggactacttactatactactaaattcagatattattagcggagtggaatatatatggcagtatcttgtttctaagttgagtggtacataaaatggtacaattctttttttaattattcataaatttatttttaatatttcagtataatttcccttaaacacaataatatgattgattaatctatcaggaatgtatcacctatgtaaatactcatgctactactaaagacagagtggaggtgactctattcacaatggaataaccattactaaattcatgattactgtgtacatttatagttttactgtaaagattgatcatttgctagctttagtcactcaacaaatatttataaatgccttctatgtgtagtgcattatgctagagtacagccattatgtcttgattacagatgcaagtatttgaaaatattgaaggaccttcatttgtgaaattcaaaaaagattccctggcagacaccaattactataataaatagagatgacttcagtgcaaacaaatgattcaggctaacaattagtaattaacaaataatataaatagtatagacattttaaatcttaaagaaaaatttaaatgcagcaatacttaagaaagggttttttaatttactaatgtagtaatcaagtctaatactacaaaaaatttctaatatgaaataccctttatatttaaataatcaaataccttgtataccagttgactaagtttagaggaatcttaaatattaaaaaacatcaataacgccttatacttcttagtatgtgaattcgtatttgtatgatgtatattattttggagagttgcctgtaagcaccatattaatataatgaatgaagcttttcttcattgaagtcctttgtaaaataatgcaggttatcctgaataaatatggtctctattccaggccatatttcctggaatatcaatagggttaaattattatggttgcaataaaatagaattgctttatcttgtccactatctacaatcttgaataaactttaaaatcctccttctgttctcttaagggaacgtggtgtgtccccatgtgtcttttttatttagtgccctgaacaatccataaataagaggaagaaggaataaagaaggacagagatttcaaaggagaaatcaaatacctaacaacatgcagtattgaaaattaacaaataagaatgcaaggcctctcatgcaaatggttccatctcattcaaccactagacataattacttctgtattcacaaggcctacagtaaggaaatactgtttaaaaaaataggctatcaattatatttatatatagacaacatgtagactgaaggattatccgaataatcctgcctagagtttctgtttttctaaatataggttttatgtcacgtattacaatttgtttcattggataattttccaatcttccatttcactttacccatagaattagactaggcattacttgaattagaatgtttctaaaaatagccacttatattaatagttgaaatattgaagtaactatgtatgatgtgtttgtcgtcattgtattgtcacctatgtttgatcagtattgtccaacagtattagtagttatttattttatgctattaatttcagtatctagagagtgagtaagtacattgtatctgtgaacactttaattatgtaagaatttctagccaagggaaagataattactgaaaaagggatatgtcattgaaggataaacacgtggcatttctgtcttctcagtggtaaagaatagtatttgttttggcttttccaattgaaattacataatctgtaggtaaaaattcacaggtgaagtattattgcatttgcctttaaacctttaatgttactattcaattaaatgctagtcacattaaagtacagtcctgtaatgtgtcataaatgcaatgagtctgttaggacattcactcacacattcaccaaatatatatgatcacctcccatgtgcaaagcacagagccattttctgtctagattctctatgtagttgggcactttatctgtgttcccctctgaaatctatcactgataataaattaacaagtttgtctaacattacctttgccatgggaacattagagctacctagggacacttccattggaaaaaagatacctgagtacactaaagtttttatgtttataaagatgatttctctacctagtagacaaatcacagtgaaactggatcctttgaattaccatggaattgctccagccagaggaaaggggaagccttgaatagagccggaggacaattactattattagagatttaggctcttaacatttccaacatagggggctggtttctactgatgagaaagggaaaatgtacagattttcagagggtctgcaattcattcaggccatctgggaatagttaaaaaaattacctcttttattcagtgagcagtactgtaacagtactaaaaagtgatcattttataatctttcactttgaagcagattgtctttctctccttctcacataggcagtgctgcatccatatctctaaattttatagccaggagtggaataactacatcttttggtttctagggctttgctgtccagtttagactcagcagaaagtaaagatggactgagccagagtgactccagtcaacacctctctccctcgaatactattttcggtccctgaagccagtataaacatggagattagaagtgaggtctttgaaggaaaacatccagatatataaattgagtacctactatgttctagggctccttctaggcacttcttcaacatattgaagacaagttgttttcgatgactcattgtgatcattatgaacttaagcttccaaaggtcattgacactgggagctctcaggaccttgaagggaaattttctccctagcccccagccttttgcaaggacttcatatatctttgtctaagaggatatttttcttccttcttttttcaaagatacatagtaggcatttaagattgttgtataagtgactgaataaataaattgctcttgcagttaaattacttaaacttgtattttacacaagtttctactttctctgtaaatttgaaggtgttaagaaataagtaaaattgagtgtgtggcttgtcatggtggctcccgcctgtaatcccagaactttggtaggccgaggtgggcggatcacttgaagtcaggagtttgagacgagcctgggcaacaaggtgaaaccctgtctctaccaaaaaatacaaaaattagctgggcatggtgatgtgtgcctgtagtaccagatactcgggaggctgaggcatgagaatctcttgaacgtgggtggtggaggtttcagtgagcccagatagtgcctgggctccaacctgggcaacagagcaagactctgtcctttatctccaaaaaaaaaaaaaaaaaaacattgagtctatcaggagtggagttgataaaaatgctttggagactatgggttatctttgaaagattgtctttgctgctctgtaatggtaacgaagaaacactatacttcagtttaatgatccataagaaataactgtcattgtgtattattagaatataatgtaataaaataaatttcatcagtgtcttctagattcaatgactattcaatgattttcatacctgaacatgtcaaagtatttggctgcaacttagcggagttgattagtagcctttaagaagctatcaaaatgaaagcagttaaatgaatcagtggtaaaggtccttgaccctgatatagccattgtctaatctcataatttgggcattcagggacatatcgggggaatccagttgttacagaagaaaccgaaacataattgaaagtgacaaatgatcaactggagattgggaaaacatgaaatagaaaaccatttgcttcaggagctgcctaaaatataagatacacacagagttcttgattttaaatcaaactttaaaatcactggtagaaaaggcagttgaaaattatgagaattcaaaaatttacttataatgcacttaccaattattatttcttccattttgtcatggttatccttgtattatctgaaacgagttgttaagaaccaattatgggaccaagaatttaatacttcatgaaactttataatcaaagaatagactacaaagtattccttctgtctttgcaaaccatacaaaatgataatagaacagtatcatctttaggatcaaagacccaaataggcattggtgtgtcatttagttgcatatgtcttaaatcaaattttaaaacaaatttaggcatcatctctcaaaatctttgcttctgtatattaatcccattgttttggaaaaaatgtatattttttacaaatcatactctgtttactggtggctcaaaaactttttagcttacatagtagttgaaaagagaatcattttttctgcagatttttgctcatctgtgtgtaatttaaaactgaaacatattaattttcttaggttttcttagtgaaatgttacatgcaaatgatgtataattatcttgtaactatccatgcagttacattttatttgctctcaatttttaatacattagtaataaatgtacactgtggaaaaaataaagttataaactttatctgtaaacctaccacccaccggtaaccccagccaataatcttagtttatatactttcaggcattatattattgttattattagtaaacctgtctcatctgtctctatcttcttaaaattgcatatttatatctatagataagtccacctttatctagaatagaggattatactctgtatattatttttaacttgattttcaattcaagctgtattatgaatatatttctctatttatatttataaatgttagcctttttttttttaggaattggaacatcttaaaccactctcttgcttttgggcatttaatttgtttccttctcttcagtattatcaacaccccattattaaaacagaaaatctttatcaagcagctttaaaaacatattctcggacaggcacggtggctcacgcctgtaaacctagcactttgggaggccgaggcgggtggatcacgaggtcaggagatggagaccatcctggctaacatggtgaaaccccgtctctactaaaaatacaaaacaaattagccgggcgtggtggcaggtgcctgtagttccagctactcgggaggttgaggcaggagaatggtgtgaacctgggaggtggagcttgcagtgagccaagattgcgccactgcactccagcctgggcgacagagtgagactccgtctcaaaaaaaaaaaaaaagtattctcctaaattctcagtggaatttctgggtcctgtggaatgtatacatatgttgctcctcctaaaaggagtggataaactcctctcctacaagcagtgttctgcactggccctttctacaaattcctttcaccctggtattatcataatctaaaaaataataatttgagaatcaaaaaataacagctatgcttgttttcttcaggaaaacagaacaggttatccatatatctgcagggtttttttctccacaaaagaaaggccagccattttcaataacaagtagtttggcaggaccagaaccattccattgggtcactggtaaaatttgtctttggctttaaacattaaggcagccaggactgtgtctttggacattgatacagcatttagtccagtcttatttacaattaggctttttgataatggcttttgggctgacgttaagtataaaatctgaaattagattttttaaagattataatcaaaaagcaaaaatgtcttcctagaaatagcaaaggaatgcttttgctggatttgctccactaactcatgtaggcaatataccaaactcaaacagccagcagttgttttgtaaaagacaaactgcatctgaaatcagtatgacaggaccacagtttccatctcatcacttccaccaacttacatttaagaaagcacaacttgaataataaaaaccaccatagagtaaacaaattcttcaatgagaatgctttgaagtcaagagaaaaataggctcagggcattgtgttacagcaaaattttgcctttggcaaaagttttacgatggaatagggtttttaaaatattgggaatcaggtaaattgcatggctaattgaactggggaagacagcttaatgagctcatttctctccttcaaatccaagaagtcagaaggcaagttttcatctattctttcatttatccaattagaacatatcgtccccacacatagggctactagaagaagtaatagttatgtctgatggctcttaggaagtattgtcaatagataggacctcctctgtagttataactacagatgatcaaattaaccagaaataaattttggtcataaatttcttcttgctccactctgtaggctacctcctccaaagcagatcgtagaccagtgcatttataaatcacagaatcaccttttaatggttatagactatatatagcatagtgacagtcatatactgctggtgctggtcaaacttgagatcaacaattctgttggatttttacccctctcttccttctttttcctcctcttccatattctgactttcaggtttgagcatgtaataacttccaggatttgttttgggcattatttatatattaccacttatcctaagattattttgagtcagataaaagtaagacattctattaagttatcttcattttgaagatgaagaaactaagattcatagaagtaaagaggactctaggagtaactaactgtccattgtcattgttaatgttacttaacctctttaatcctctgtcgtgaatccaataacgatcaaagtagtaggcaagtttgctgagggccaactgtgtgacaagcactttgataactgattggtctttacagcaaccttatgagagaagtattattactctcatattatgagtgagaaaaataaggattaaagaggtacaggcaattactcaagaacacagggctagcaaatcaagaaacagaagttagatgtgagatattgtatcacccaggcctaaaagatgcaatgaaacaacccattttaaatgtttaatatagtaaccagagtatactctcatttgatgagagtatactcatcaaatgagagtatgcatttgatgttacttttcacagtggcctttttgcagttaggaaacagcagcaccaataatagaactaagctgtctgactcccagcctgtacctaaatctctaacttttgattttatgaaataaatttgatttgcagatgggcattgctggtgagggaaatgtaaagaggtcaatttccccactttaaatttttttggctaaagacccatagctgacaatattttaatggttgccacatattcttcttttatgaagtgagtttcattttatatttgtaagtggtttttattgcaaatcatcacctaacagtcaattctgaagactttccataaatgtcaccttgtttgtgaattgttctcattctgtctcctctctaaattccctcaagaacaactttctttggacattaatatcattattaattgtgaattgtcagctaacagcttagcaattgtctatcatgctcctaatgcatggatgatacagagaatataaagtcaataacttgtatttcctgaaagatacatatacagaagccaatcatttcagtagagtgacaggagcaagattgaggtattaatagagtactctgagagatgagaagcgggacaactaccttagcctaaaggtttgcaaatgattgtggggaaaaataatctttatcactccaaaaagaatattacagtgatattttaattgaccatagagtttaacttgaccattgtaaaatgaccaaaagggtgaattattttttaccaattattaaaaagtagcactacctgatataaacagtgtgacctaatgtttacattcttattattttttctcctttttgtctttttctctctccccagctaagtagaaaaaactcactttgttttcatgctaaaattttggaataccattaaacagcaacacactggacaactacattcttatgttttatcttctccctttaagattgttaaaggaagaaattgaactagtggggaaaagtaaatactggccaaaaaaaaatgcttttgactagtgtatgttccaatgatgattatgaaatatgtcaaactgttctaaaatactaaatatgtgttactatttattctgtattaaaatagaacaatagaataacctttgttgtcccaatatgaaaatagtttttaacaatgttaatataaaacaaagagcaaaggaccattatcttggataaacagagagacattactttacatggtttgactcccctgattcataatttaacatgtaactctggcatatgctgggcacttagggaagtcacattaagtatttcacagcaaatggagagtgagaaaaatgattttcagaaatcctggtatttacttattataaatcttgtcttgaatttattgtactttacatgaaatataatttgataaaatgtaattggtttcagtgtgtatgcaaaatgagaattttctgatcattcagatatcaaaattaactttataaatacaaatacatataattacctattaaaattctaaggtgtatttattttaataaaagtctttatcaaacctagataaatctcatttatgattataaatgtaaaactcctaaatttttttttacttggctttatttactattaatgatgttgggtttattaaaaaatgcaagcacagactccaattagcctactaacctattgtataatttatcaattcaataggtcaaacaattaaatcagaacatttaataaaattgacaatatttttttatttttttacaaaaatccatattggttgttttgaagtagcaatttcttcttcaaaatgataaaaattgtctatgtaaaatcaatagtcaatactataaaagctgcaacattatagacattttcattaaaatgagtaaaaagataattatgcctatcacactactataccatataaattaactattatgctgaaaattctggccaataaagtaggggaaggaaataaatataactgtatatttaaaattatgaactaaatcttcactgttttacaggcaaaggaaaattctaatatctgataaaatctttaaagtcaattaaaaaagagtatactaaagaaaaatgaataattttctcaaaaaggactatatctaaccaagaactaggtgaagattggcattactagtatccaaagacataaatactaaaacagtaattgacatattatctaaaatcaaaatagtgaagatataacaattatgggcagaacacaagaaaatggacattctcagatattgctggtgtgagtatgagtttaatttttctagaaggaatttgaccatatttaacaaaatctttaaaatgtttatactctttgataatgtaatttcatctcataattttcttaaggtaatacttagatatatatccactcccgatccccaaaataaaatggaaaaaaaaaaactaaatgtgtaatgattgcagaagggttgaatgttattttatgagaaatataagaaataatgcagcaaaatacatgatgtttaattatacaaaactatgtagtaatacaaaatatatgatttttaataacacaatacccatgtatattcataattttgaaaagaagaaatatatgcatatacaaatttgaaagaaattatctcatgttgacattttgacttatcatttgctagtcaaattaccagtgcttttaattttctacctcctgcctttgttttataaagaatatttttattatgtctatagttatactaaactcagttcagttgaattgttatttaaatctatggaaaaaattttgctttgtccataaattgtatttatattagaaagttaaaataattaattataaaacatatatccaggtttttttatttgttccagtacataacagacctattacataatttgagtaaattttgtcttacagttatacaggcagttctctccttacacaattctgatatgcatgaatatcagttatcatagtttagttaaatgctaacagtcctccaacaacgtaactcaagtgttgggtaacattgaatattactgtgagtaattacataaacaaacattgctgctggctctgcagtccacaaattaccacataaaataacagatgcacattgtgatcagtgaccgatcacgtttatttttttcagtatctgttggtgattgcgcactacacatttatcattcagtttatttatagaagagaagcgtgtggttgtgttgcctccttgtgagtgataaacccgagtgacactttacaaacacagatattcaaaaaagaagaggaattggacagcaaagaggaaagcactgcaaagaaagaaaatacttgaagtaaaattcagattgaacctaagtggagtcatagaagaaatagtcactactgaggtttgagagattctgaatacgtagccagagctacttagtgaaggtgaacttaacataagtgagggaagtgcttgccacaaatagggtgaagatgtcctggaggaagtgacacccaaacacttcacattagaggaattctcacaggtacttcacaacactaaaagcataaaagttaaaatgttggaagctgattcaaacttagaaaggagcgtgacaattcaccaaggcatagaaaagaagtggccgggtgcggtggctcacgcctgtaatcccagcactttgggcggccgaggtgggcagaacacgaggtcaggagatcgagaccatgctggctaacagggtgaaaccccgtctctactaaaaatacaaaaaattagccaagcgtggtggcgggcgcctgtagtctcagctacttgggaggctgaggcgggagaatcgcttgaacccgtgaggcggagcttgcagtgggcagagatcatgccactgcactccagcctggggaacagagtgagactccatctcaaaaaaaaaaaaaaaaaaaaagatgcttgtgttcagtgtgataagttataggtgagatgaaggcaagcactgttcaaagtacttttagtgagtattttacaaaggactaaaacaacttctccaagtttttaatgttttaaattacagagtactaaataaatggtcatttttactggtttatttctttacatttataaccagcattggagagttgttaacatgttgaagttttacaaagtcttagagctatcataacctttcctgttgattattaagatcactttgcatgtttgtaacacaaaggttaaacacttgaggggatagatgtcgcattttccaagatgtgatgattacacgttgtatctctttttcaaaacatcccatgtagcctataaatacatacacctactacgtacccacaaaaattaaaaattaagaaaaaaaaagatcattttccatggttcaagtttgcatggtcacttttacaattccaccctaccatgcccgtaaatatgctatttctgacttacgaaatatttttcaaataaaatcattgctgacttttaactcactgatatgtgctttacttctggtgaaaggcctaacatatcaataaaatgaaagaaaatcacagctttattttctttactgttctgatattttttgttctagtgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggtaagtagcaaataaattcctgagttggtttggaggcctgtgtgcttctatctacaatgcatattattttaaattatgttattgctatcttatttaaggatgtactttcatacctttaagtttgaaaatcaaagctagttcaccaaatcttcctatttccaaatcactaggtagttttcagaaatagcactctagtcttaaactatatcttttcaggaaaaggattttgttgttgttgttttgttttgttttgttttttaaagagttcacaccatttgactaaaccacaaccatatttagaataactcgggaatgcttactttgaacacatatccttaaagtaagtttccttttgtcccctttattgtcctttatgtctggattctcatgtggagatggcattcattcagatttggcatggacactggtagtctgagaatactctttttgaaaatactaattaaatggagacgatgataatcaaagtcctgttctaaaactacaaagcctttgactagtcattgaaaaataccatccttattttgaaaggcaagaaatggccaacatctgaatttgtgaaatataatagcatatatctgatgggtttcaaagtggtactcttaagcatgaatccatttatcggctgattattgataacttaaatatcacaagatcttgggtaggtgctggggacatgaagatgaataagacaatgaattttctgtctttgggttattgtacagtgggaaagacagactattgaaaggaatgattacaaagttgtctgatgattgctaagatagggcaaggacagtaggagttaaccagttgaaagattaggatggtgaactaaggcttacaattagggaaacattttgtgcagtggcctagaggagggagaaaaatgacacgtttgaaaaaccataagatgggcaaatggctggtggtaagagatattaggaaggaaggcaggacaatatcatagaggactctggagccatgataaagcctttggcttttatctaaggtcaaggagatgacacttaagggttttatatgggaaaggggcataatgagttacttgttattaaaagatacacctggttataaagtaaaaaatggattggagaaggttagagtggttggggaaaactagttagtgaggtgctgcaatagtccaggtgagaaataatgtcagaatacatttcagatggtacggatagagagaaatggatccaagagatatttaggataaaaaagtgagtgttttgtgagcagagtgtaggcaagggaaggaaggagagccaagactgatacctaacattacattctagcttgagcagtaggctcaacattggtgccagccattgagatagaaaatacaggaggattgagatgagggaggagatggcaagttctgttgtggatatgttcactcggtttctaagagacataggagaaactcctgggggcagttggaaacacagttctgaagctctttccttcaaggaaatcctctcatgatgctttagagaagatcagaatcacttacacatgttagtgacaactatgcttatcatggtttataaatgtgtattactcctggtattatttagttcagattcctcttacctcctagactgtaagagagctttgtgaaagagatgcaatgggtattgtgtatttagtttactactgtattacacagcacttagcacagtatttggtacatagtaatcacgcgataaatattcattaattcataaataaaagagagatttctggattggagatatggatttgggagtcaacagcatatgtaaatggaaatagtctagaaatattataaatcaatttaatttttaactagctcaatagccaatatctatcagaatatgagttttcatattattgattattgattatttctgtagtcttcaaatattggagaaatttcaatattttttgagcaaagtacatcatgtttaaagggggaattgatagtcttgagttctacttcagcttatttcaattatcttatacactagtcacgttcactttaaaaattccttgtagtttaggttttttattacataatatagcaaaggaaatttgtaattataaattataaactatgggaattacctgatatatctaatatgtcaggctattctagtatttagtatgaaaagtacttggtatctctaaatataatgaatttctatttcaatctttgaaatgaaaaataatggccactaacataatcatttgtttttaattgtgttaactacagaataataaattatattaagagaagtctcccattttacatgattgagttctagaaaaatatttccaatactacatacctgcttgcttcttactgtataagtatcatctaccacatatgtagaaatttctcctgctgtattgagtttagataaagtgcctggccccagatataaagttttaagtttaggagcaaactctttccaaatgtatgggcccctataaagcacagctttttagaagtgtggtattatataacagatgggagtttaatgaagtaaagcacagtttgtaacaggttcattgtttcatatgctctggatcactaaattggcaggtagagatgaaaggtgcattaaaacggacgttccgaaaattatagaattccctcaaaggaatacagtctttaattttgaattatgcagctgattttaatgaattagaagtcataatgcataacctttccctgatgcaggaaggaactgtgagctgtgcaaggattactttttccgacaagttggtgcagatccttcggccatagatgtttgcaaaccctgtgactgtgatacagttggcactagaaatggtagcattctttgtgatcaggtgagtttttctgagtatttaaggtaaaggattactctgtctgccagaaacttatttggatgttattccactagtagaattgaagactgcatttgccaggaaatcctctatgtgcatttgcatttcaaagagatggttgttcgtgtgcaactttgagtatggacatgaaatatagcactagttcggtggtcctttgcatataaaaaggcttattttagttttaattttacaaatgtcaaaaaatcgaagggtaggggttctaagtaaattggggtatatgtcttggaattattggtgaattaatattaatacatgatataaataaacaagaatagtttctccaaaaattccatagaagatcatatagcaaaagtcacttacacttagggccaaatggaaattatgatagcctcgcttctcaatttcttagtctaactttccctcttaaaagtacaatggattttttataattttaaaactttctgtttacttacatcacaaatatcgatgtctagcctacatgcacacagattctaactaacctcagttcatgtatcctacctcaagcaggaaaacaggcttcttattgaagctgaagtttttcctgttctgataatactaataagtgaaaattgtgaaaatcggtaaaggagaaatttactttgaagaatcaattcaatgattgtattaattttaaacagttatatactctgttatgaataaataaggctaggagcataaaccacaatccagttatagaatatttgttaaaaagttatattgtgaacataatacacacaagacaaaatatctttctcctataattttgagaattcattaaaaattgctttcccaaataaaagacaaatataaaccaagacaaaatatggattcaaagaccttcagagtaaccatcatgtgtcaataagggggcattacatgcttcattagaaagctgaagagtagaaaaattattaataaagacaatttctactatttttattttataatattgagggactattttctcagaaagtcatactacagttttccatatattaattagtaaactctgactgtatctttagattatatttcatttttacacatccaccctgagttttcagcatggctatcttttgcttatcattcaaatattgatatatcatattttgagatatctttgctgaccacccaattacaaaacattctcaagtctttcatatcaccatgttactctcattacaggctctgtaaaattaatttatttgtttacttttcttcttctctctttccaacataaacagaacagtttcgatcatataaaaagcccccaataagtatttgtcacataaatgttgaatgaataaagagagattatctgagcactgatcttatagttagattgttattttaaacggtcattacaataatctgagcattatgtaaattttcacttgcagaacagtttttctccctgaaaatctaaggtcaagagctttgttatatagtataggaagactgtaaactatagttttacctcccagaatctcagttacgtgtctaacctacacgagttacagtgcatcagatttgtctctccatttcaccattcagatctacaagaaattgaaacctgatttttctgaactcaaacttctatttcaagtccgttttatagggatgctagacaaccttgggtggttctgtgcttgtaaataattaacaactgactaagaaaaaaaaaaggccaccataatcaatttcaatctaccagtgagatgtcactgaacatggatttcagaagaaatgtacttaatctgctcttatgagccagtgcagtgtactccagcatactactggctctagatttctttcttaacatcttataaagtggagctaattattggatggaattatgaaagactgtaccatttataagcaggatattagctgtagatagtgttattttttaagttggagaaatttttctctattcctagtttttctgagagtggtttttatgaatggtgttgaattttgtcagctgctatttctgcatcaattattatgatcatgtgatctttttttctttagtttgttagtgaagtagaatacattggttgcctttcaaatgttgaaccagcattgcatccctggaataaaaccacctttgtgtgtgtctttgtgtgtaattcttttcatatattgttaaattttatttgctaaaattttgctaaggattttacatctgtattcataagaaatattgctctatggttttgtttttataaattgtgtttgtttcattttgttattaggataatactctcgtaaaatgaattataaaatcttccttcctgttgtttttctataagaaatgcagaactggtgttaattactctttaaagtttaccccattctaatacatagtattctagtaaatacagtaccccatgtattagtccatttttgtactgctgggaagaaatacccaagacagagtaagttgtaaagaaaaataggtttttatttatttatttatttatttatttagagacagagtctcgctctgtcacccaggctggagtgcagtggctcaatcttggctcactgccacctccacctctggggttcaagctattctcctgcctcggcctcctgaacagctaggattgcagatgctcaccaccatgcctggctaatttttttcttttttttgtatttttagtagagacagagtttcaccatgttggctagactggtgtcaaatcccacccacctcagcctcccaaagtgctaggattacaggcatgagccaccacacctggccagaagaatagatttaatggacttacaattctacgtggctgggaaggcctcacaatcatggctgaaagcaaaggagaagcaaaggcatgtcttacatggcagcaggcaagagagaagtgccgagtgaggaacagggaaagccccttttgaaaccatcagatttcatgagaactaattcactatcattagaacagaatgggggaaactgcccccatgattcaattatctccacctggttcctcccacaacacatggggattatgggaactacaattcaagatgagatttgggttgggacacagccaaactcacacttggcccctcccaaatctcatgttctcaccattcaaaacaaaatcatgcccttccaagagtcccccacagtgttaactcattccagcattaactcaaaagttcaagtccaaagtctcatctgaggcaaggcatgtcccttctgcctacaagcctgtaaaagcaaaagcaagttagttacttcctagatacaatagcggtacaggcaatgggtaactacacacattccaaataggagaaattggccaaagcaaagggcctacagtccccatgcaagtctgaaacccaatggggcagtcattaaacctcaaagttaccaaatgatctcctttgactccatatcttacatccagggcatgctgatgcaagaggtagctcccacagccttgggcagctcggcccctgtggctttgctgggtacagccctccttctggctcctttcacaggctggcattgagtgtctgtggcttttccaggcacacgatgcaaggtgttggtggatctaccattctgaggtctggaggatggtggcccccttctcacagattcaccaggcagtaccccagtggggactctgtgtggggggtctgaccccacatttcccttccacactaccttagcagaggtacttcattcattagggctctgcccctgcagcacatcctctgcctggacatccaggcatttccatacatcctctgaaagctaggcggaagttcccaaacctcaattcttgtcttctgcacacctgcaggcccaacaccatgtggaagctgccaaggcttggagctgccattctctgatgcaatagtctgagctgtatgttgatcccttttagccatagctggagcagttgggacacggcaccaagtccctagactgcacacagtgggggggccctgggcccatgggaccattttttcctcctaggcctccaggcctgtgatgggaggggtgatgagacatgtcctggagacactttcccccattgtcttggtgattaacatttggcttcttgttagttatgcaaatttctgcagccaacttgaatttctctccggaaaatgtgttttgcttttctactgcattgtcagcctgcaaatttttcaaacttttatgctctgcttcctctttaacacttactacttagacatttcttccactagataccctaaatcatctctttcaagttcaaagctctgcagatctccaggggaggggcaaaatgccaccagcctctttgcatagcaagaatgacctttactccagttccccacaagttacttatctccagctgagaccacctcagcctggcctttattgtccatatcactatcagcattttggtcaaagccattcaacaagtctccaggaagttccaaactttcccacatctttctgtcttctgagccctccaatctctttcaaactttcccacattttcctaccttcttctgagccctcccaactgttccagcctctgcctgttacccagtcccaaagttgcttccacttttttgggtgtctttacagcagcgccccactacccagtactgatttattgtattagtccattctcactcaactataagaacaaacctgagactgggtaatttataaaggaaggatgttaattgacttatagttcctcagggcgggggaggcctcagtaaacttacaatcatggcagaaggggaaacaaacacatccttcttcacatggtgacagcaaggagaagtgccaagtgagggtgggggaaagttccttataaaaccatcagatcatgtgagaactcactatcagaagaataggatgggagaaactgcccctcatgattcaattatctccacctggttcctcccatgacatggggattatgggaactacaattcaagatgagatttgggtggggacacagcgaacacatattgctccagtaaaactatctcagatttctttggaaacagaaataatttattattaattcaaaattaaatactacatatatatgtacatatatgtgtgtatatatgtatatatatagagagagaaagacagagagagagatacaaggaaatgagagtcatattaacatcattaggaatttaatattactagaagacagttcagaataaccttaaaatcccaaaagaagacattttgaagaaaaacttgatactcagttctatccaagctatggcaccaacatgaggttaagattctttttgtacgagagatggtcaaaacattaccattcataaccccatattaaaatattcaatatgcaaagtgaaaaaggaatgtaagactggggacaacattaaacaaaggaaatgacaaacaattatgatccaaagaaataaatacataagtcaaaaaatattttcaaagtatccattggtctttatggtctgcaaggatagtttccttacatacatgtttagtaattcaattttatttaagatcaaatcacaattttttgtgatttgagataaacaaataacaagtagagggctaaaaatactatatccaaatatttcagtgagaaactggatgcttttttcctaagatcaaaagcaagataacaatatcccataacattgtactgaaagttgtagccaagaaaatgaaataaaagacattgagactggaaaaagagaagttatttgtatttgcatatgccattatcttatagatagaaaatcctaaggaattaattcaaaagtattaaaactaataaattcaggctgggcgcggtggctcatgcctgtaatcccagcactttgggaagccgaggcgggtggatcacgaggtcagcagatggagaccatcctggctaacatggtgaaaccccatctctattacaaatacaaaaacaaaattagctgggcatggtggtgggtgcctgtagtcccagctactggggaggctgaggtgggagaatggtgtgaacctgggaggtggagcttgcagtgagctgagatcatgccactgcactccagcctgggcgacagaacgagactacatctaacaacaacaacagaaaaaaacctaataaattcagcaaggttgcagagtacaatatcaatacacaaagatcaattatatttccatatatttgcactgaacaatctgaaaataaaattaagaaaacgtcttttaaaaatcaccaaaagattaaaatatttagaaaaacatttagtaaaagaagtgtaaaattatattctgaaaaccataaaacattgctgaaataaagaagaactaaataaatagaatgacacccaatgctcatgtatcagaagacttaatattattaaattaacaacactctccaattgatctacagatttagtgtaatctttgttaaatgcccaccttacttctttgcagacattgaccatatgatcctaaagtttgtatgaaattcatgggactcaaaaatgtccaagataaccttataaaaaaagagttggaaaactcacccttcccaatttcaaaatttactataatcaagacagcatggtactgggataaagatagacatagagacatattcactgaaatagaattgagaatttacaaataagccctcatatttatagtcaattgatttttgacaacagtgccaagacagttcagtggagaaagtgtagtcgttttaacaaatggtcctgggacaattgtgtttttatatgcaaaagaatgaacttggactcctaccccacctcacatataaacaaattaattcaaattaaacaaaatattgaatataaaagctaaaattataaaatcttgagaagaaaatgtagatgcaaatcttcatgtcctcggattagccagtggctttttagatatgacaccaaacgcctaagaaacagaagataaaatgtgtaagttggacttcattagaattaatatttcaaagcacaccaacaagaaagtgaaataaacaacccaaagaattagttgcaaagtatataataaatctgtaataatgaagaaaatatttgcacagcatatatctgataagaagcttgtctagtatatatgaagaacttgaagtgaataatcaaaagacaaataactcaattttaaaatgcgcaaataatctgaatagatatttctctaaggaagatataaaattaccagcaagcacataaaaagatttttgacattagtcatcagggaaatgcaaatcaaaactactgtgcaagcccacttcccaaccagtgggatgactgcaactcaaaaaaaaaaaaaaaaaaaaaacagacaaaaacaaaatttggtgaggatgtggagaaattggagtcttctcataggctgcctgtgagaatgtaaaatgtgcaccgactttggaaaatggcttagtgtttctcaaaatattaaagatggaattaccatataacccagaagtttcactcctctgtatgtatcatatatcctcataaaatcttattggtgaatgtcaatgccacattgtttgtaatagtcagaatgtccatcaactgctgaatgaatagataaaatgtagtataatcacacaatggaatattattttacattaaaaagaaagaaattactggtacctgctacaaaatgtgctcaagtctcagaaattagagtagggaaaggaagacggacgaagaatagagaaagcttgttttgttttgtttccaagtgcaaaaatctgttttaaaaatatatggaaggaaagacatgctttaaaatgttaacttttttggttttaaaaacatttttccttttatataaacttttttctctttccaaatctgctttatttataacttttatagtcagaaaaaaaggagaattttcattcaacctgatatatagccagagagaattacacataagaataggaatgtaaataagaatgatagaactgttttctgactttaaacccccacattgtttatctttaaatcacattcatatattatcttaatttttattattttctcatgctccaagtatagagacaaagtttatggagtatcgttacatgtggagatattgtgtcaagtctaccttacctaaataatgttataaaagatttcaaaaaatgtttccagacattgtcaataggataacagaacacacacttaaaaagttgtcaacagtgtcagaattataaactgcaaaattgaattcaaggacatttaaaaaattcatgcaatttcaatccttaataatattagggagcacacaaggaaattaggcagtagttcaagtctcattttgttataataacttaggaatgaagccagccccaaatggcctgagtgactgtgtcgtgcgctctatgttctggaagggaactttccctttggcacttgtcatttgaaactcaatccaatctcataagatatggcatgtttgccttattcttccataagaaatgttgtaattcttccttatgtgaatgccaaaatcttgagaggggcataaagtaatgctctgagtcactgaatcctaaaaatactgatgccacagtcaagacagagagaacatctaaagcacagtactaatattaataggagagaggaaaatgaagagtaataatgattattgaggaataactaacatggaatccttggatcccttgggttactatatgagtgtatattttatgtctgtataaattgagtaggatacaatttatgtctgtgtcatacaactgtaagtctgtgtatttttccttttttttttcttttgtctgtatttttgagggtgagagctttcagtactttcatcagatccaaaagggatacatgaaccaaaaaagatgataattatttcaccatggaaaagaagtctatcttatgaacaggctgggttattagttcaggtacatattatgtgagtttttcaggataccactgcacttccttcttgtttgcttgaacttaatgcatgaattacttgacatgcatcctgagttggaggttaactgtccttttccatttcctcatctagtgtgacttaagttcagatcaatcaaatagagtcccaggcctagatgatgcctcttctgtactttgacatatctggagaagggtctgtgaatccacacctaaagtgcatacatctagagatctcagtctgatcctgacccaaggtgggagtgagccgcttgtctccatcctttccctccactgaccccactcctccacatattttctggtagccccagagtccctgctatagccacctccacaggtgatggtgataaggtagggagaccggtgaaagtccctaacataagtccctagcatatggcctgactcatgtagaatgcattcaagaaatattgtctgagtgctttcttgcttgggacttttttcatccctgctaccttctctcccgtttactttgcttgttattgggttgagctgaggaagccatgggggttcagccactgtagtcaagatggtggtcatcagctagggtagtcctcaaacttttaatgcacatgtgactatcctaggtatctttttaaaagacagattctcattcaggaagtttggggttggggctcagattttacatgtgtaaaagttcccagatgatacaattgccgcctgtctgtgaaccactttttgataaccaaggagttagaacactgtatatcaaagatatgtagaccaaagaagctgaatgtagatgggggtaggggagttgtgagtgtgtactcacgagcacatgtatactcttggtcagttgtgggtttactttgctccatcctctgaatcccatcttaaaagcaaggattttccaagtcatccaaattaagttaggcttgaattgtgccctgggctctacctttaaaattagagtatatcacctaatagccatttttaaaaggaaataaaaacaacaaataagggaattaaaaagttgtgtgaaaaccaaaaatatagttgtaattatataaaaagagagaatagcagattgtaatgctcaataaagcatcaataggttactgtaatagcaacagaacagaaataaatgattaagagatatttaaaaatagattaataagaaaggaaactgaggttgaaatgaattagacgaaatggaaaggcatcagtgaaagaagcatttctaggtctgacctatggaagatggaataataaggaacagagaccctactcatgaaaattgattgttctggtgaagtgataattttcaaaacaatacatttaaaatttgaacagaatatactttctctgcataatgtaccatttttctgcagttcattaatggtttctcttctgttcagaattaggtatttgtcattaattaccataacatgtccaaaagtcatcaggtgaacttccctgaagtatattcttatattttgtatgactcaaatattaaagtgtacaaatagaaaaaataagtattgcataagtttccttagcttatgagaaacctgaccatgaatagtatgatccatggatattggatgtatacattgaggtggtgaaggatgtgaaaagaggagagttttcccagagcttcaatagagacagaaaggtcttggcacaagccacgtggtctctccttcagagaattagggaagtttagtagtaatatttctcatagagctggtaaattgagtaatatctcattattctgagattgtagaggatgagattcacaaagacaggaacaaaggtcctggggtataaatgggaaaagaagggaaaaattaatcttagctggataggaaggttagtattgagggagttatccaagaatcaaggttgtgacaaactgcctgaaagtaaaaatagatggagttgtaactgagatgaggtcttagcctccagtttatgttgagttccacatgtttgaatacatctgacatctttttgggaacaagctcatcacaagggcccaggtatacaaaattggccaaataccaatacctcaggcatttaaggctagattcaatagccctaaatagccataatagcactagcagaagcattaggtagtgtctggatattggaagaactgatttaactagtaagtgcaagataatgtgatacaaggcccattgccttgctaccaatagcaatgtagttagaataggctaaacagatgtaacaaacccccaaatatctagtggccaaaacaatatacaggctcatttgttgctcatataacctctccaagacagctgttcctacctccttgttggatcttctctttgtgacaattcagggacacatgctccttccattgcctggatatgcctttaactagggaaggaaaagacaatgtggaaaacaacttccacttttaaaatgctttggtccaaaagaggtgtgtgtcgcttctgctatcattgccattgatgatagctagtcacattgctaactagttatatagaaggctgaagacatgtagtctctagctgggtaaccactttgcagctacatttgtgtactattgaagactagggagaatgagtcttgatggggagcatgtcatctctgcttaatactcatgcaacagaaggtagcccaagagcgaaaggggcattctcttcttttctacacacagaacaggataacttctgtttaatgaggacctctgagaatagagtaccccatgagcatctcaggggtgccaagccattaatattggtgggactacctgcttggaggtggaccctgtaatattggtagatgcacctgtgaaagcacatatcatagcagcatgtatcagcaagagagaattggacataggaggagaaacagcttgtgtgcaaggttaaaagatttgttcatgagcacatgtgagagagaagccccaggaacaaggaaatgagaaaacaattactgcctcctacatgttcccagaggagggggctgggagagcaattaagcataaagagcattaattgcatagaagatgctgagggatcatagatttgaaagcaatttcaaaatatgagtattttaagacttttagcaagaacagacaccataggctgtatatagtttcctggagttatgattaaaggatgaaaacaacttttgtttagatatgtaggtaggtaagtaggtagatatagatagatatgagaatagtaagtttgtttaaacaaattattcattacatcatagtgacccttagtgctttttgatgatactgactgatatggtttggctgtgtccctacccaaatctcatctaatagctcccataattcccacgtgttgtgggagcaacctggtgggagatgattgaatcatgggggcaggtctttcctgtgctgttcttgtgataatgaatgagtctcatgagatctgatggttttaaaaatgggagtttacctgcacaagctttctctgcctgctgccatccatgtaagaggtgacttgctcctccttgccttctgccatgattgtgaggcctccccagccatatggaactgtaagtccaacaaacccccttcttttgtaaattgcccagtctcaggtatgtctttatcaccagcgtgaaaacagacgagtacactggcttattgaggaacagaatataatcagcctccttcattcctcactcactaaaccaatgtgctgatcatttctagaggcaaggacactccaagaatcaagaaagagccgatgatgaggctttctattattctcctggactggacgttgtctcagcttctgctgggccatagaaccctgcctctaccttgacttacccacatgttgttttggtgccaagtattgagtgctgcattttggggtgtacaagacagattggcatattgctaaaaatgtgcgaggacagaaatgacagaaactagtctgtaagattctcataggttccacttgtcttgcactcgtcatgtacaaaaatatgccaagcattgtagttcattaattcagtccttaccaaagctggtaaagcagttattaatttatccactgtaaagttgaggacatccagccttttggaaattaaataactcctccaatatcacacaagtaataaggaggttgtgcagaaattgaaaacttgtgaatttccaaagctcatgcccagctggaggttagagacatagggttcctaccaaaaatgtgttcctagcactcagcatagtgttcagcacttaagaggaaacctacagcagattgctaaactgggtatttacttacactatccaaaagtaggaaggaaacatacccatttgtttgtgaattattgtatcaaatcctattaatttcatcctaaatattaaataaaattcctaaataggaaatagcaatgttcatataaagaagcagcaaattaatttattggaatcgacacattcctcaaatggagatttggttgatattagagacttaatgtacctcccttagtgcttaatgtataacagagattccacttatcttacctatataacctaagaaatttgaatattttataaagttactttttagaaaacctgatttatttgttttccttgtcatctcagatggataccttcctctcaaaatctatttggaatttatattttcaagtattcaattaactaacatattaagcaggcattctcctgtgtaagttcctagcaacttttaccacttgtactaaaataaaacagatagttaagccaaatgagttaacttttctgaaagtgtatctttatacaacattaactatagacatggaaaatacatttattcacgttagaaataaatgcttctgtgagatctttcattttgataaagtcaaaacaccatcttattaataactactatattaattttgcagcaaattacaataagaccacactgtatagttgtgccattcagatgacatttatgaaatgctctaatttaacatggtgacatatattacctgcatcttttacacattatagcttatatcctctgagcgaaatagacctaaaccatccaaaaaaaaagagagagagagagagaataatgcaatgggaaattatacccctttgagaactagaaggactataattacattgcttcctcttaaaaccattcaaatatgtaaccattgctgggaacagcagtatgtggggaacctctttacactctttctgtcttgaacactcaaaagattgagaaaaaaatattcctttcctactatagttttatttgagcatgcttcagaattttacctttttgcacactccttagagattatcgtggggaagtttagaaagcagtttcttggaaatgccttttggaggggaagaggagctataaaaatataccagcctgacaaatgacaggcattgtagactggaaaagaaaagacatcttggttttacaccaatgtagaagcttttctttgcaaatgagtatttttgacagctgagcaagatgataaacagaagtatcacaaaacacttaaatggaaacaagtattatgatgtactttattcacctggcattctccaattcatgacatttatatgtggcagaacccactgcagattcatttatttatttttgaagtggaatgagttccttacgaaggtagcctgttacattaatgtggacttttcttctctagatgcagaagcttaaggaaaaaagttattgtatctgtactataaataagtggtaagtctcagaatccacatcttagggctgagaaggctcctagcaagtacaatatactgtataaatatagacaaataaatatagatatagattttttgtgtaagcaccggcagtgttgcaaatgattagatatttcataaatgccttttctaaaaaggtattgctgaaaccagtctatttctagaacttatattcagatgtttagaggtataaatgcttcaatattggctaagcttagaaaggctatgtttctctgaggctcagtgatagacataccaacaatttgatgagatgcatgactaagaagaaaaagagagtaagactgagtccctgtgaattgattgacttggtgcagtggcagagtaggtagcaagtattaaagcaatagttcttaaatgttagtgttcataagaatcatcaacagaactttttaaaaatgaagattcctaggttttaactttagcgacttttaattctttaggtctggtatatttggttgtgggaaatcaaaagactcaacttcggaatacactgaacagttgctgactatagatttgtatattcaaaattttttggtatttaaaaatggtatgtatggtttattgagtcaaatattttaaaaactatgaatgtgtgctggtttgtttttttttttttttctggattggaggacaatttggggtaagcattctctatttaacaagtcataattaactccctgccaaaactaagtagaaattgtgatttctataactcctatatttgataatatctcctaaaaatatttcagtgatatagcatttaattgcaaataattcatctagtcaccaaacaaatgtagggacgttcctatataccaggcactgtgcatatcaaggtgtatattacagtgaataacagaaacactcacgaagtgttcaattgaatttaaccttgaaatgtattatttattattattatgtttaaataaactatgtgaggtttttttttcattgccaatgagaaacccaccctaacttcagaatttttatctttaagtatatcctattttaaccacccttacccatccactctcaatgatttctcctcagtgtggggccttgccgtggaagtgtgccctggtcagtgagttttgagagtccgtggaagctagattgccctcggctcttcagttcccactgcagaactcttgcagtcactggctattggatcagcagaacctcttctattttcagtcgcccattttcaaattggctcactgaactttaggttctccagttttcaggtctttcaaaagtccgacacccctttactatcatctgctttctcctacacaggggctaatgccatgcaggttttgtgactgctggtggtgtgttcctacctgctttttttgggaggcttctgggcacagctggtcacctagtttcattataatcatttttaatggctttgctgttgttgtgttgctgtttagttctgtcagcttttatcctgggatttagagagacccaagagttctgtggccacataaccattgatcctgattcccctggagtctcttttgacttttactgcctaatttaagctgaacatatgaaatacatgaaaaaactgaaagctcaagctcgtttgttgtttgtcttcctaggttatggtttccatttctccctctttctcaacctattttgccaatcaatgtctatccttccttcactttttgcctactcactacaatattcaattacacaaacataatttttcctctgcccaccccagcaccagcatttttctgggagtttaagtctcttatgaatctgggaagaaaggaactaaaaatgagcagggatgaatagcaaaatgagtgagtcaacgagtagcaggcaggacattagagtgaagctgttttcttacccagaagactgatgatgggaaaggaaaaaagaacaattcaaaattagtagaagaaaagaaataattaataaaacatgagtggatattaatcaaatagaaattggacaaaaaatagtgaaaatgaacaaacgcaatagtttgtcctttgaaaaggttaataaagttgatgagcagaaaacacaaagtaccaacatcaaaaacacaaattaccaacatcagaaatttaaaaaagagacatcaatgtcgttgcacattttataaacattaaaaaattacagttttatgaacagctctgctaataaatctgatgtcctgaatgaaatgaacaaatgaacacaaaaccaacaacaaaaaatagaaatagcctcacatatattaaagacatttaattcatatctaaaaacctttcaacaaggaaaatctcagtcccaaatggcttcactaatgaatttgccactaacataaaggaataaataatattagtcctacacaaactctttcagaaaaccaaggaagggcatatatttctcagctcattttgtgagggctacctaactttaatcccataacctaacaaagcactaaaagaaaagcccattagaatattccatatgaacatagatgtaaaataccttaacagcatattagcaaatggaatcctgcaatatataatagggtaatgcatcatagctgattggatttctcccaggaatgcaaagttagtttaacatctgaaaatcagttaatgtagtaagccacataaatagaatacaaaagaattcccaggtaatcatctcaatagatcaaaaaactttgaaaaagaattcaaaacactttcatgataaataccctctgcctactaggaatacaagagaacttcctcaaactgaaaagggcatctgcaaaaaccctatagctaatattatgttaacaataaatgttaaattttttaccactacatcaggaacaaagcaaggaggtttgctcttataacttctactaaaaattgtaacagaagtctaaagtaggacaaaatgaaaaaacaaaaagccatgaatatcaagaaagaagtaagactattattatttgcagaaaatatgccactgtatagacagtgggagtataaaaattgcttggcaagcatcaagtcccccacatacaatcccctcctcacactactctccttcgtaaagccatgaaaaaccgctttatattctaagtaaggacgggatgtttgatgtgcaaatgcagctgtaagataaatccctgagcaacatttttggccaccctgcccttcctatagaaagtctggggctgtcactgaggtagggttagtaatggtatgtgagactggagagatatgtggaaaccacctcatggtatttggtcttcactagttaggcaatagggagctattgaatatttctgagcacaggagtgacacagaggtgtaccaagtaggtaagaggcagtggaaacaatctacctcagtggggaagagtattgtatcacaaaatttgtttagaattgctagtacttggtgataattaaaagcaaaacaattttaactgaatcttattattttaattttacttacagaaagtgcatcctcttttgtgtacccaggtgtttcattctcaccaccttaccgtaggattattatcatcagaattaaagtagatgaggcaaggcacagtggctcatgcctgtaatcctagcactttgggaggctgaggcgagaggactgcttaaggccaagagtttgagtttatggtaagctatgttcgtgccactgcactccagcctaggcagcagagtgagaccctgtctcttaaaaaaaaaaaaaaattggaatgaatgaaaattaattgatagcagtttattaaatggattagggagaggaacagactggtagatatcattcagtatacaatagctggttagtgatggcaattctgaaagaagaagtggtagaaactgggaggtgttgctagtgtagtatgacctttcaaaactcacagagtgcatagcttgtggatgtatagaacaatgtgaaagaataaattctccagaaaggaagaagaggagttagagattttataaaagagaagtctatgatgttctctaggaaagaaaagaattttctgaagaatatatgcattgattaaatgatttccttttgccctcatttatatttattttctgttcaaatgaaacacttaaactaacactcaatttccgggacagatttcctgttcttacattcttcaatttgctttttaaatttttactttgtttagcaatatcaacattgcctcattggcttttagtgagtttcttgagaagatgtaatctatagaacattagttcttctctcccaccagacagatgagtgcatagaaagacatatagttatactgctgctgttttaaaagtgttgcttcaaattacctaaaatatagtgactattagataatcactgataaaaactgtgttcatctaatttattcatcttgaaatcatgcttcatatttcctttaagcacaaaatagttatgttcacacatgcacaataaatcatatatggattacttgatgccttgaattcaccctcatagaattttatctcctaatgtaaagaaaactgactggggtaattattgcaggatcttactcttttctgttgtcagtaaccttcccaccaaactcattgtgacaattgtcacccggttgactgtgcatatccaccattgctccagagcctaggccagcagacttttgctgcatggtccaaaatggtgaggtcctgggtgtgatcacaaggcaatatgcagcaaacattagtgaccatcagtgctaacaaagaaacttacaaagtaacaacttgaccacttggccaattcttccactgtgttttcagctcttcacaggtgtaggccatgccttaaacttaattgagtctagcactcttcctgttactattattatatttgtagcttatgataagcagagtgaatttaacataggggttatgatcatgcatttgagagttgggccacttagtaactgtattagtccgttttcacactgctgataaagacatacctgagactgggtaatttatacaggaaaaatttatacaggacttacagttccacatggctggggaggcctcacgatcatggcagaaggcaaagaggagtaagtcacatcttgtatgggtggcagcaagcaaagagagagcttgtgcaggggaactcttgtttttaaaaccatcagatctcgtgagatttattcactatcatgagaacagcacaagaaagacctgctcccatgattcaattatttcccactgggtctccccccacaacacataggaattcaagatgagatttgggtgaggacacagccaaaccctattggtaactgcaccacctttaataagtaatttgatctttctaaggtttaaattcttcttctgtcaaatgaagattcatgtattttcacaaataataaaatgacgaaaattcctgccactatggagcttacattgtaaagtgatttggggagttggaagagaaagaacaatcaataaatataaaaataagtaagtttatttactaagttaaatgctataggagaaaactagacaaagtaaaatgccttgagagtaccatattaaggaaaggaattgcagttttggaaatgtagccaagagacttttaattgaaaagatggcatttcacttgagacctgaaggagatgaaggagttagtcatgtggaaatctggaagaagagacctaggcagaggcagcagcctatgcaaacaccataaggtggaagcacccctgatgtattcagaaaaggggctgtatagctgaagtgagcagaagaaagagtaggaatgtcccaagcctacgggatccttgtgcaagctgcaaataattggtcctttcactttgcaagtactgccccacatccatcaaatactttagaaggtttgaaaaaagtttgactatcaatcacttgatgaattttcctgcccactatttgctctataccagtgtgaaatgtacagagtaatacttccacttcatctttaccgagcacttactatgttccagagatgatgctaaacatgtttacattaataatctcagttaatcctgacaacagacctatgaggtagatattattatgctcattttattgataaatacgtgaagacttcagtagatttaagttgttcagagtatagttaattctgtggctagtaattgtggcacataatcctaatgttccaggaatttatatcatttagttgaggagacactcctcaactcctgtctcaggtgacaggagtaagtgaaattctaaggcacaatatagcatggtgcataagcaggcaggactgcagccacagaaccctcaattttaattcaggctaagtcacttactttcccttttatgttagagacgtctgttagtttttctacaggaagtataatacctcacagggtaatttattcacaaatacgaaaacatgtataaaacatcatagcagtctgcctgcaatatcgtaagtgttcaaaagggttgtggatattattattgttgttgtaagctaaggaacgctagaaaaacatcaaagattcaattactcaaaataacttttgctgagcatctactacatgtaaaatatgtatactgtgggatcaatggatgatgtaaaggtgcaaaaggttctggcccttggggagtgtatggtacactgggaagttatattttcagacaagacataataattctaatacaagctagaccttaaggaattgaatgacagaggtaacaagaaaatgctgtaaaatggctgaggagagaaaaatcctctaatttgggaggagctcagtattgacaaaggctagaaatgggtagagaacactttcccaaaagagatgtcgtggtgcctggtgagacaggctgtgaacttgacttctcccatccgttccattattaatgtgtgtctctgtgctctagcattcatttcatcttgtggacatgctattgtttccatttaaaaactctcttgatcacaatttcttctgtggcgatggtctcatgtcctgctctcctttttggcaaaactccttaaaagacttgtctaggctcatgcctccaaatcctattctgctattatttcctggaaatatatctgtcaggccttcactctcatcattactttgcaacttttcttgttaaggtctccaaggacctctgtctttttaaacaaagctaaattctgtcttcattgtatttgacatacaagcaggatttgacacagttgatcactctcttttcatttagaggactccacattctccgggttttcctcccatatccctgactatttcttctgtatcctttttctgtgccctcctcttacctttgaacacttattgttggagtgctctggaactctctttagaggactttcctgtatctacgctcacgcccttggtgatattttacttcaaataccaattatacacagacaatactcaaatgaatttcacaatcatatttccaattaaacacttaacatgttttatatatatatataaaatattatttgaatttaattatctttatcttcacatcaatacataataatctatcagcaaatcatgttggttctattttcaaaaatatccatagtctttcattcttcctagattcaataattcctttgcttgtctatttagttttctatatgtcattaatcttcctcatgctgacgtctttgctacatgaatatatacatatatatggtacacatacatatatattttatgcacacacacatacatatttatgctcaaggacctcctgccctgctatcagcctagagcttttcatatacctctacatcctcatttcctgaatcccatgccttccattcttgttgctgttgtctgtttactttctttttgctggaactatattactcaatagcttcctgatataggaagttaaagttttgaatccttgcaaatccagaaaatgtttgtattctttctttacaggcaaccgataatataacttagcatagaattctggattagaaataactttactcataatttggaaggtaccattcttagctttttagtttactataatgttgcagaatactgcagtgatattctgtattttctatgtgacttattttattggtctctggaaatttttgtttcctttttatttttggaatttgaatgcttcatgagattgcaccttgatctgggtttttccaccagcatgtggtgagccttttttttaactttttaatattttatttttaatcaatcaacacataatatttatacctattatgggatacagagagatatttcaatacatatgtaaaatgtgtgagtatcaaatcagtgtaattagcaaatccattaccaccaacctgtatcatttctttgtgttgggaacattcaaaatcctttcttctagctatttgaaaacatataataaattgttgttaactatagtcaccatacagtactataaaacacaggaatttattcttcttacctatctgtgattttgtatctgttaaccagcctctccctatccccttctccctgctatccttccaagactccagtaaccactattcgaccttctactttcatgagatcaactggtttagcttccacatatgagtcagaacaggtaatatttatctttctgtgccaggcttatttcacttaacataatgtcttccgggctaaacataatgccctctaggctaatccatgttgcttcaaaagacagagttttattccttttcatggctgaatagtatttcattatatatttatatatgtgatatatgatatatatatatatatcaaattttctttatctattcctttgctaatgagcacttaggttgattctatatcttagctattgtaaatagtactgcaataaacatgggagtgcagatatctcttcaacgtactgatttcaaaacgtctggatatatgtacccagtagtgggattgctgaatcatatggtagttctctttttagtttttttaagtgaccttcatacttttttccataatggtatgctaatttacattcctaccaacagtgtataagaattcccttttctctgcatccttgtaagcatttgttattttttgtcatttttataacatattttaactgggaaaagataatattgtggcttttgtttgcatttgtctgatgattagcaatgttgagcattttttcgtgtacttgttggctatttgtatgtcttcttttgagaaatgtctgtccagaccatttgcacctgttttaattggattatttggggccattgagttgattttcttatatattctaggtattaaacatttcttggatgaataccttgcaagtatttttccattctgtaggtcgtctctccactttgttggtagtttcttttgctgcgaaagggcattttagtttgatgtaattccatttgcccagaccaatgtcctgaagcacgtctcctaggtttacttctagtattttcatagttttgggtcttacgttgaagagtttagtccattttgagtggatttttgtatatggtgagagacgggggtctattttcattcatttgcacatggatagccagtttccccagcaccatttattgaagaggatgtccttttcccactctttgtttttggtgactttgttgaaaacccgttggcagtaaataggtggatttatttctgggttctctattctgttccattggtttctgtgtctgttttacgacagtatcatgctgtatagctttgtagtaaattttgcagttaagtagtatgatatcctcagtcttgctctttttgaacaggtgactttgtctcaagattgatttgtctagctcagtggggtggctcacgcctgtaatcccagcactttgggaggctgagttggacagatcacttgaagtcaggagttcgagaccagcctgaccaacatggcgaaagactgtctctactaaaaattcaaaaattagcagagcatggtggcgggcacctgtaatctcagctactcaggaggctgaggcaggagaactacttgaacccaggaggtggaggttgcagtgagccaagactgtgccattgcactccagcctgggtgacagagagagaccccacctcaaaaaaaaaaaaattgctttgtctattctgggtctttatggttccatgggaatttaaagaattttttcttctatttctgtgaagaatatcattagtattttgataggaatcatattgaatctgtagattgcttttgataatacagtcatttttataatattagttcctctaatccatgatcatgggatgcctttccattttcttatgtgtcctctttaatttctattataagttttatagttttccttgtacagaacttttaccctttggttacatttattcctcagtatttttgtttttttagctatcgtaagtgagatttcatttttacctagtttgtgcttgttgtataggaatgctactaatttttatatattgatttgatatcctgcaactttattcgtttagtttatcacttctaagagttttttggtggagtgcttagtttttattacatataagatcctgtcatctgtaaaccagaactagttgacttcctcctctccaatttgtattcctgttatttctgtctcttgcctaattgctctggctaggaatttctagttctaggttgaataaagagtagtgaaagtgggcatcaccatcatgttccagttcctagaagaaaagttttcaccttttctccgtttaataagatgttggttgtaggtttgtcatatatggcctttattattgaggtacatttcttccatactaatttgctgacagtttttagcataaagggatgttgaatttcatcaaatgctgtttctgtcttttgagatggtcatatggtttgtccttcattctgttgatatacttttatttatcccatttattcaatttgctcatattgaatcattcctacatccttggtataaatcacacttgatcctggtatgtaatatttttgatgtgctgttggattcggtctgccagtattttattgatgatctttgcaactatggtcatcaggaatattggcctgtagtttttgctgttgcatatttggttttgctatcagggtaatgctggccttataaaattagtttagaagaatttcctctccttcaattttttggaatagtttaagaaaaaatggtattagttcttctattaaagtttggtagatttcagcagtgaagccattgatcctggacttttctttgttgggagactcttaattactgaatcaatctcattacttgtgagtgttctgttcagtgttctattcctccttggttcaattttggccagttgtatgtatccacaaatttatccatttcttctaggtttttcaatttgttggcatatagttattcataatagtctccaatgatcaactgtatttttgtggtttcagttgtagtgtctcctttttcatttctgattttatttgagtcttttttctttttttctcagtctagctaatggtttgtcaatattatctttcaaaatatcaactttttgttttgttgagcttttgtattgtttttggtctcaattttatatccttcttctctgatcttttttatttctatattgtgccttgcagaggacctttctagttaaatacatttgggaacttttgagcttcctggatctgggtatctatgtctgtcccaagacttaggaagttttaagttagtatttcattaataagtttttattaccctttttgtcatcttgtctttctaagctcccacagtatgaatagctgtttgcttaatggtgtcccacaagtcctgtaggctttctttattctttcttattctgttttctttttctttctgtctgcttgagttatttcaatagacctgtctttgagttcataaatcatttttttctgcttgatctagcctgttgtcaaaactcttgattgtatttttatttcattaactaaattgctcagctccaatatttctgtttggttcatttttatgataccaatttcttgttgaatttctgatttagatcatgaattcttttcctgatttttttcagttgcatatctgtattttcttctatcttgctgagtttccttaacatcattattttgaactccttttctggcattttgaaaatctcttttactttggggtctgttactagaggattattgtgttcctttggtagtgtcatgttttcttgctttttcatgtttcttgtgttcctacattgatacctgcacatctggtaaagtaattgcttcttttaatgttatggactagcgcttatagggaaagatttactcctgtagataagttctagagtgttaagtagagggtgataacttgggtcctgagtgggcacagtagtgtagtctctgtgaagtttcttcaactgtaatccatgtcagtaatgtttgtgaatgcttcactgacctaacctgtgggagtttgtggcagcagtgacatgactttactggaatcaggcttattgagtgagttatcaggatggaggcatgtttgtgcatgtgatgggtcacctagcttaggaactggcttgctttgggtgaagccgtgggctgtttctcaggccgggggcatgagtgttcagtggatcagctggttctggaactggttcaccaggagtgaggctgttgggtcgtttctcagtttaggggcataggcacatgttggtttgccagccattaagccttttaaaactatggtttcatgtctggaaaatgtgtattttatactaattctttattaacttattcctttaattttttttccttttggtgtatttctgaaaatttgttttcatctcattattattgttagcctttctgatgtattttcttatctttctcttctaatcttttagttgagatttttttccagcctttttttttttttttggatatagaatcttagtatattgtctaggctggactcaaactcctgggctctaacaatacttctacctaagcctcctgagtagctgggactacaagcacatgccactatgcctggctgtatatttttaatatttaagaattctttctttcaccaattgtttattcttttaggcttttttttgtttctatattttttaatgaatgcaacttttatcttctggggataacagagatattttattaaattgttattagttgatgatttcttccatctctaattccctgcattgtttgtttcctcatctggattatcatttttcatcctcctcctttatttttgtttctgtcattcacattgtatattttgcacatttgatgaattttgccatctgctttattctgtagagaaatggtaaaacatttccaaaatggcctttactcatgtttatgagcagcaatacagctttactttgcagaggttaaaagctcaaatattagttctagagttcttatctttgtagtatttttctgccagtttcctctttatggaaaataactctggctcccggctttctttaaactgtgtagaaggggagttgtggtggtaaaggggagaggcagtgtatacagactttcacttaatcctttcatgtctaccttgtgcctcttccaataacaagttgttgatgttccaatataatggagctggttaatttcaattattcttgacaataagactgatgtcactgtggagtaggattagtttggctggctgagtggggttgaaaaggggacctgaaaatctaaatactttctatgtggaatacctctaattcatgattctcaaccttggcactatggctattctgggctgggtaatttgttgtgagggatggatatgtgcattgcaggatgtttagcagaatccctggctacatatcagtatactacatgccagtagaactcctcccctcactgggacaaccagaaagttcctctggggacaaaatcttccttagctgagaaccattgtttaactttagacctgtgtgtgtcctcttacttctctcaatgtttcattatcttcaagtcttaaggctctcaaagattctataggaaaaatcagttttcatgttttaggaatccaattcagctagcactcaagctgtaacttctctgattattcaagaatgttgtcaatatttatttctatttcttaatttcattttctgtcttcaaaatttttgtaaaatgtatttcttccctattgatttctctgctggcctcattaaaattatgggttatattttttaaaattcctatttttttaattgaagtatcaagaaaaagaggaaaaggcacatgcttgatctgaactttatcaaaaattggtaattgttttcatctcttactattaactcttttttaaatcgatcctcttgctttaggaatccaaatcagcctgcactcgtactgcagtttctctgattagtcaagaacgttgccaatatttatttatatttcttcatttcatttttcgtctttgaaatttttgaaaaatatatttctccattattgttttctctgctggtctcattaaaattatgggttttacttgttaaaattgctgttattttaaagtagtgagaaaaagaggaaaatacatgtgcttaatctaaattttaccaaaaattttatattttagtaaatgtattcagatgcatatttttctgacaatgggcagtcttagttaacacctgtatcctttttcttgagcaagaaaataaatttattataatttttacttattctgccctagtattcctcatggataaatcgtgtcttaattttattaatctttgaatgcatcaattctaataagttggatcctttgtcagaaagcagaatgtgtacaatatacttatcccttagttttgtcttcctgggaactggctcttgatcacaataggatatatacctacagatcagcttcattataatttaatttactgtatttggcagcaacatcttctagtggtaacctagaccgagatgaaatattccatttcaattgacagttataaagctacagaccatagatttcagttatttgagtagttactacattaaaacacatctttttttcccttcctttgctcccaaccacatgtgcagcaaccagtatgtttctaaattttgctcctgtttataatgctatttcttaagcttctaaacatcgcagtgtgcatttcacctctgctaatctccatccaaattctgctatgttttggagtttgtaagaaagtgtagtgctgatgaggggattgaagtttcaggattccaattttggctgcttaacaggaacagttgaaggatggcatgaggtttttgatccatggttttccatttccctggtatagtaagcataggtatcactgccaaacttctttggagctctatgttatttgggttgagagcttggagctatgttaaacagctgaataaatgtttcccaatgcagctctgtctatgatgcagctcctgaaaattctctctgaatgttgtcaactagttttctcttaaattgagtttatagttgttttgtcaggtccaaatgtctttttgagactttactttgactgaacattgtgatagaatttatcctcctgcttgaaatgataaaaatatggacaaaatgtattaaataattgtttgctagatgttggacatcaggcaatgaggacaatgtttgctgagaaataggaaataaattatgtgaatcttacaattgacccggattactgcttacagagtatttctagaccacgacttagggagagaaatcccagatggagctcagagagttctccaaattgaagagatatagccaagtgtttcaggaattcaaagtagttagagtttgcagagagcagatagaggaacacagagataatttcacagatctacagagcatcttccttaagaattcactttactacggttcactgcatgtatgaggctgcagaaagcacaactttcaattattaaaagtaacaataattaacactcatgtaatgctgggtatgtgcctatttccactagctgaactggcgagaaaatttatgattcgtgggatatttgataagagtacacaaaagggtctagcctcaacagtggagaatagccctaggctgataactacttcaataccacctaataaatcttaagagcaagactcaaaaggaactgtttccaagtaatttaactgcatccaagaacaaaacacaaatatatttgtaagaacactgaaatatgtagtacctaacaagaaaaaattcacagtctctggcaccaaatcaaagattatcaggcatgtaaagaagcaggaaagtacaacttataatgaggatgtaaatgcatcaatcaaaattgatccagaattgtgagaaatgttagaattatcaggccagtatgttgaaacagatattacaactctacatagtttaaaagctacataaaaatatggaaggtactaaataaccccacagatcaaaattccagagaaaaacctacactgtatggaatgaaaatacactggatataattgattatacattaaacataaaacatttatgttatatataaaaaattagtgaacttgaagtcatagcaatataacctatccaaaatgaaacagagttgaaagagcatttgtaaaaatgaaaacagcatttgtgagctgtgggacaacttttagaggcttggtatatgtgtaattggagtccctaaaggaatggtggggtggaggtgggaatataaaaaatattcaaataatttatggctgaaaaattccaagtacagtacactgaaaaccataaagccacaaacccatgaatctcaagaaaactaaaaaataagtaacatgaaggaaatcacaaaaggcatattataattgaattgctcaaagctagtgataaatttttaatgataaaataaaatactacagcagccagaggaaaaagacgtgttaaatacaaaggcaaaacagtaagaatgacaacagatttcctatccaaaataatgcaaagaagaagacagtggggcaacattcttataactatgaaagaaaataaatagtgcacttatgattctatatctagtaaagatatctaagatgaaggtgaaataaaaactatttgcaatacatataatgaaagagttcatcacacagaaacctatactataagacacattaaaaagaagtccttcagtaggaaataaaatggtatcatatggaaatatggatctgcacaaagaaacaaagagcacccaaaatggcaactgcattggtaaatacggagggtatttttctaatgatttaattttctttaaatatagttgacagtttaaaaaataataataatatagtaaaagttttataacatgtgtaagtaaaatgtttggcagtaataacacaataattaagagggggaaaaggaagtacccttgacccttgaacgacatgggagttaggggcactgattccctgcacagtcaaaaattcaagtttaattttgactctccaaaagcttaactactaatggcctaccattgaccaaaaaccttactgataacatgaacagtcaattaacatttattttgtatatattatttactgtattcttaccataaagtaatctagagaaaagagaatctttaggacaatcataagaaagagaaaatgtatttactatttgttaagtgaaagtggatcataaagatctttgtcctctttatcttcactttgagtaagatgaggaggaggaataagaggaagaggagagattggtcttgtggcctcatggctggcagaggtggaagaagattcttttataagtagactcatgcagtgataacccatgttgttcaagggacaattgtataccgttgtaagatccttatactctatttgaagtagtctgtcacttaaagctaggctgtgataaagatgtaggataaaaaccactaaaatcataaaacaaagagttataactaataaaccaacatggagataatttgaatcataaagaaatataaaataacacaaaacaggcaaaaaaaaaaaaaaggaaaaaagaaatcccaagcagatgggacaaataggaaatatcaagataatagatttaaacataatcatatcaataataatgctaaatttacatattctaaatactccacttaaaatatacagattggaagattggttaaaaaaggaaaaagtacaacttaactatatgctgcttacagaaaagatatttaagtataagacacaactaggttaaaagtaaatgttggaaaagataaatcttgtgaacactaatcataagaaatctagggtgactttattaatatgagaaaacatgaatttttagaaattttgtccaagataaaatattgcccaggatgaagaaagtaatttcattttgcaaaaggagtcattttgtcaataggacataacaattcttaatatttctgtaccaacagcagagcttcaaaatgcacagagcaaaaactaacgtaactgaaggagaaagtaaaatccacatttgtcggcaaaaatttcaatacccttctctcaataattaatagaacaaactgacaggaaataagtaaatctatagattagaacaacactgtcaaccaacttgacccaatggccagttatggaacattcaacccaacagagcagcaaactacacctacttttcaggcctacacaaaacatctaccaaaataaatcaaattctgaaccataacacaagcctcaatagatttaaaagaattcaaatcatataaagtacattatggggctgcagttaaattaaattagaaatcaataacaaaataacctggaattactctaaatatttggaaactaactaacaaaattctaaataatccaagattagaagaggaaacccaaagaggaattaagaagtattttgaactgaatgaaaatgaaaacacagcataacaaaattgtgagatacccaatatggcaggacttagtagtatattaatagcactaaatgcctatgctaggaaaggatgaagatttcaaagaaatatcttctactttacaaaactagcaaaagaagggaagacccaagccaggctaatgaaagctatttctgagtttctaactgcatctcatggggatgatcatttcttttctctgctcttgtggctgaaagcatgttaaggccaaaattgtgattcaggcaagacccaaatttataagaccaagattgcattttaagccataaagagcaggagaatctccatggcttgaactgtgaatagatatttgtttgttatcagagatagtaattgtactgctttatctgtatttccttccatgttagtaaaagaaagctcagaagtagttgatcacatgatcatagagaataaactacatttctcagtctccttggcagctaggtgtagaaatgtggtttaagttctggtcaatgatattttatctattaacgtttgctgtttaagttagtggctaaaaacaataaaaattgcgtatttatttaggattctatggtttggctcagtgctggtgtgcactggcttgtccaacctcttctgggctctctcatttgtctgtgattagctagctggtcaagcagcagttagataggaagacctcactctcatatgtggtggttggcaagctggctgttcactgggacagtaggagcaattattagctggggcacctcagttctctgccatccaacctctaatattccagcaggatagcatgagcttgctcacaaggtgatctcagagttccaagcccagcaagaaagaatgaactctaaatttgcaggcattttaaattgtctgtttgaatcatatttgcaagcattatatgtgctagtatttggccgaagaaaaccaataggtcaatctagagttattgtggaaggatcgtaccaaagagtgtcttagtgtatttttaaaggaaaggggaatgcctttctctctttctacttcttggtggacagcaattggttttagagtatgagtagatttgtattttctcacattaaaaaggtagaatctacaactgtggaatctatagaagtaaactgggtattttcagttgaatcttgggaaactgactaaagttaacatttttaaaaataataatgctttattttatttttaaactacattttaagatatagttaatatacagaaattataatctatatgtgttacagagagattaatgaaatgggagtaaacttgttattttattaatttgtggcagagttcatatagaaagaattgtttttattgacaaaaatatctcgataagacttaggttttggcaagaatcaaggcaatattatacacttttgagatgtctgtgaaaaagtgaccatgtaaagtcaggtgtatagaaaaaagtgaatatgctttatagcagagcaaggaggaagaagagagaagccacagaagatggtagataattggagtgcaagatggtaggtaattggagtgccaatgaaaatctctagctatagggaaactaaagggatattatgaattgcaaagtaatgatttaattcctcttttaccccgaatctttaataaggtttaacgactacaatttgtttgtttgttttgaacaagacttcttgaaattgaggcattagctgagtttcacctctgggtgacatagggcagtgctggcagaagccagaaagacttcaaaatggaagaagcagaagtgtagggtcagggcgactacgaaatgatcaatacgcatagaattcttataaacttaaggaggacttctgtcattcagggatggaattagggtcataggctgccttatctagatttcaaaaggcaaggacgctccagatgatacatgcattacatgtaaataagaatacaacaaggccaggtgcagtggctcaggtctgtaatcccagcaatttgggaggccgaggcggacagatcacctgaggtcaggagttcaggaccagcctgaccaacatggtgaaactgtgtctctactaaaaagataaaaaattagccgtgcctggtggcccagctactggggaggctgaaacaagagagtcacttgaacctgggaggcggaggttgcagtgagccgagatcgcaccattgtactccaaatttgcaggcatttttaaatgtctgtttcaatcatttttcaagagttaaactccatctcaaaaaaaaaaaaaagaaaaaataacaaaacatataaaagataaaggttttgcacttttatttctctttaccttttgcacacttccttgctctttgaaaaagtattgtttacatgtaatgtttaagattattctttgacggaaacatcacatatgtccaatgccttaaggtgtttactatctctttggagaacaggactgatcctgtaaagtaccagcaaagactcaggcctgagttatgggttgatgtacttgaagtgttacaagtatgtacccacacgcctattggattttcatggtatgcctatatgttacacatatccaccaataaatgccatctatttttgtaggctgaatcaaatctctgtcttgagtaatgattttgtatcctttggactagatctgaataagactgagaaacagccaggcacaagaaggcaattcattgttctcactcatctttctaaacctatatgcatctttgatattgaggttcattattagctacaactacatttggtttgcatataaccatttatttttcagtcttagatattttcatatcaattgtcttaattatccttaaataaagcttccagtgagtctctatttcttggatgaggacaattgaggcagtgatagttctttaaaaattatttaatttctaagtccttcactatatcttgtaactgaatcccaacctagatatttttaaatatccttgaaattaaatataaatcaaataatatctttccacatgtaggttacttccctctatggtaactctgcctccaaatgtgaagagctggattcaatccaagtgaaagaaaatcagtggggaaaatgtcagggactataaaagagatttgaagtctgtacccacattgctgtgttagagtcctgagttattaaatttctcatatttatttgacattttatatacatatgtccacttatgaagagtttagttcttatctttctttaatcaacacagtattaactatgcatgtagtagatgaacactgtattttatgtatttgcattcttttcaaaccagatgcttaaagaataaaatgacacagtgttttagctgttattttgctttaaaatgctttaaaacaagaaacatttttggaatttcttatcacaatataaatcagctaagtatatttaatgtggtgaaatgaatcataaataggctgaaatagtcctaaaaggggagttgggtaagaaaaaaatgtattaggatcaatatcaataggcataaataattctattaacaaataacattaaacattgttacactgtttatgggatgatatcattatatcattatagaaagattctcccttaatttaaatacctagcatgtacaaaacaagtttaaatcaatgagacagtaaacaagaggaataaaatagagaggtgggctgggtgcagtgattcacgcctgtaatcccagcactttgggaggccgaggcgggcggatcacgaggtcaagagatcaagaccaatatggtgaaacctcgcctctgctaaaattacaaaaattagctgagcgtggtggcgggcgcctgtagtcccagctactcggaaggctgaggcaggagaatggtgtgaacccagaaggcggagcttgcagtgagccgagattgagccactgcactccagcctgggtgacagagcgagactccatctcaaaaaaaaaaaaaaaaaaaaaaaaaaggggaagtggtgtcctaaagactaaattaactgctgactattttctattttcagtctctacatatttatatttttatttctttatatagcattgaatggttaattccccatttcccttttattcttatacgactaacttctatgggttttattttcattcagttctgtatattccccctgctgaagcctcccatgttgtgtgtcaagaggaaaaatatcttattaccttcttgtctgttgaacatttagttttcttctccctccctccctgtcttgtacctaatgagcaaattatctaaaaatagatacgttcatcattctacaaaatgttgtatcttctctagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattggtacgtgtaacgcaaaagtttacagtcacatctctattaccatctggaataaaattctctatttgatttcttaactgaagagtaaagcaaatttctttgctcaagacaggctggaaaaaaaaacaatttggatgaaattaactgtttaaaatgattaaattaataattctatcaaactgcagcttgaagcttagtttaatcaaccctttagaagtttctttattctgtagatgcattaattcccatggtcccatactaataagtcatagaaaaatataatttgcttactgcatagatgtttcttttagaaaattagcactttttcaaaatgttttacacttaatgagttctaagcaaatcatttccatgctagttttcttaatagaccaaaataagtggattttttcaaaatattctgtgctacagggtcctttgtgataaatctttccatttttttctgttatatttctttgaactgttcctatgaaatgcaaaataagtcaacataattctacagatcatgtatattgctagggttacttacaaagggctacataattttaattttgtaattcagcaccaagttgattataataaacagctgccttcggtgttatttatcatttttttatacaagacgtgcttttttgtttgttactcccacaggtatttttcggaaattagatttgattatagcaatttattacatccaacatttttgaggggaaccaccgccacataaggacaaaatttatcaagtgcctaaaatgcactatgttcataatgcactttgaaattttgatatatgagaatattatgagaggaaagtttcctgatgaagtgagccctgtattgtaactgaatatgtcttggttcctataggaagtttaaaaaagacctttgcctttctattgtcattcaagacaccaagtcatccatggtttttctaacactgacctgaaccttacaatagtaaaaatatgcctggcagtgattacacacactcctctctctctctctctctcacacacacacacgaatgcttacatgtacacatgcatatgtacatatcattctgaatactattttcatttctgtgatatacctctaaatctaattctttatcttttatttatgtaagtgtacatcatgctacacaattcagctagacaagcgtttcaatttaataaagagaatgtaggtgtgtttagtggcattacacgagatttctctggtttaaagaaacattacatgaaaatctgtaccataatttacctatatgcatctcaagcatacagaaactaattttttagaaagaaagaataacgtgtaaagagaagtacatatttgtatgtgctatccatgatgctgaaggaattctaagaccctgaattcaatttgtatggcatcctttgttctttaatgtgagatatattttaaactcaagatgtgaaaacaaaagttaaagcaagacctttaaagacagtgaaataattacttctttgtatcaatggaatctttcttgtgatggttagattccagagcttgaggaagggaaaaatcaaaattaatttagaatgtataatgccatccctactatttgcctgttttgttgattgatccagatggttttctgcaggaaacataaatatatattttgtgaagactaaattacttcagtattataaataattattatttctagtgttatttctgcaaatgtagtactttttataaaaacaaaaacttgatatgcatatatatttactttcctaatgggatcagcaagtaactttattcaatttcaccttgttaatatgaaaaaaaaagaagcccagaaaatacaagtgtatgttgtatacgcttcagaaagcaaactgttagagttaacaaaactgttaaatcttactaatgattctatcaccagtaaaatacattagcaccaataattttattaaagtaggtcattcatctagaataaaaagggagaagaatgtgaattaaatgccaagtgtgctaactcgcctgtacttgttaacaccgaatgtgatgccctgtaggccttcctgactatcgttaggaatagattacctgtcaggaatatgtatggcatattcaaataagcactgtgcatatttttaaaactgatatgatatgaatccatgtagaccaattttaatagttcaaaatgagtcataattcttgttaacaatacagttatttttaaaatttgcagcaatagtggtccttttttattttccttattgaaattaaatgatatgccttaggtgagtcattcatcactgttaaagaacttgccttcattggagttcttgaatttttatccatatatatacatatatattatgtatttccttccagtttaggaaatgcttttctacatatgagttcctgagtatgtttttgactcttattttaagattaatttttaaattgcaattatagcttgaaataaatgtttcagttgattcaacccatgcagtgagttatttaaattcatggatatttggaaactatctaaaggaagtattttgcatctaaacatttactattctaatttttttatttctttgccttgtaatacccttttatcttttagaataaccttacttgtcagagatttaagtttaggtgataaaacatttttcttcattcgtaaaatgtatatgtgtactcctttaaatagaagtaatataaaaaacagaatttacttagtgtttaaagaggtatgttctgagtcacacaagatgacaagcaatgtgattgctttatgagccaaggagagcatgatttatattaattgaaaatgataaaatagaggagcatacaaaaggattaaaccaaaaattgccctggataagttttatttatattaattacttaaatgtgtggattcagaaataagtgtatatgctgttttcacaaaaatagttatcagctgacatttttttcttttttcccagcttcacgaaggtataattaaataaaaattgtatatatttatggcagacaacatgatgttttgatatatgtacacattataaaatgattaattccagctaattaatgtatccatcacctcatgtacttatcatgtttttggggtgagaacatttaagatctaatctcttagcaattttcaagtatacaatacattattattaagtatagtcaccatgctgtacaatagagctccagaacttattcattctgtctagctgaaactttgtactcagcttaaccttttattaaacatctttagagatttcttatctttagaaaaacaactaatttgttatatgtaattctactataattttaaatgagcacatttgttaaaatagtttttaagatttgttaaagagaaaaagagctccagcatatgtaacagaaacaacatttgcattaagcatttttctttgcattaagtaataattaaaaatttatgaagttcatcgcaaacagttgtatattaaagctaaattaaatattgtcattgaattttgagagtaagattggccccctatggcattgcttgtgagaaaacactcaatattttgtgttcgtatcatctgcagtagcattgtttgtgtctcgtctatcttgaatgaaatcattttcccatcctcaccttttaaatatattttatctttagggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtaagaaagaaatgtattacattttcagtgcacaatgacattccttttgttaacttaggtaacttctccctgtttctggtttgtggcttctacaaattttatttccaaaatcattactgtatttatatcattatccaacacatatataactatttaacttattcaaaattatctgcatatttatgttactattttgagaggatactttagataaaactcagccgatcggatttatttcataattgagactcaatttctacacttgaagtaaatctcctttttaacagttttttaaaaatcagatcaacaagagtcaattttattttccagagaaaggaaaatttgagttgaatatccatacaatgccaaatattcaaatgatgaactaaatctctgaataaagctggctaaatgtttttgctgaagaggctatatgttctagttttatatagaaatacctagaattgtttccacatgccatcaaattaataaaataggccactgtttaatctcattatatacaaacttatctttccatctctttcccaattgggagagggatagaccccatctatggctctccttacatttaagattttaactaaaatactataccttctttacaataaattcattatgatatgatgataaatataagtacttatccgttgtttaacagctgtgctaattgttgtcctgtcagccaatattagctctgagttatatgggtctataaaaatgagcatgataccaactcaaaagtgtgatttgcttgccagagaaggagtagaacaaaagttctgttaacatagcaaagaatccagcctaggataattgggccatgcttttcctttggcattggtcagtgtgtaagatcaaagagacaagaaggaattgatgaagagttcattctttttgtgatgtaagtattaaaaaacaacttgaactggtttaaacataaatggagactatattataactagatactccataaaaacctaaggagaaggaccactgcagtcaggactcaggaattagaatgcttccactgatacatattcatttgtctctctctctctctctctctctctctctctctctctctctctctctcagaaggggactttacctctctctttctctacatgggtatatggccaccctatgtcccctgaaattgtttataattctaccaccagccacaacagagcgatttattagctacctcttagttataatttctagaggaaaattcgaattgactcagttttgtttggttggttacctctgagccaattcattgtggccaggggtgtcacgtacttataaaatgagtatagcttttagggaccatttcatcaggtagaagcaaggtggtaagtatcccagaagacaggaagattatggagacctgggcagacagcctaaatgacagatacagcacattcactctttttaccttcaggttaatcctttcaaatttgcaatcaattaactttttgatatcctaagatgagatgtttttttctcttttagtgtttatcaatatctctaattttggcaacaaagtcctttgtctcctacacagtcaaataaccatgatttatacatccttctttctaagtaaaccaaaacaagctaatagatcaaatgttatatccttttgagtaattatcaattgttaaaatttactgttccagtctaactttaattgtatgtataatacaagtcacatgttttaaacaatttttctgattttggaaaaactctgaaatcatagttacaaacatttgttccctttggtccttccaatgaaagacccaatccatcatctcaatactttgtacacctaccagatatctaaatgatgaactaaaattgttagaaaacctttgtttttctggttgttttgcatatcattgcagaaaaagccatggataatttaatctacaccatgcataagactgtctcatttgttcccttcctaggatgaagaaatactgacttcattgctctttcctttatctttgtggctctcattgtggtgatctctttgttcccaactctaagcccttttctcccacccaaatctatggctctttcctgtctaccctatatagtattggcagaataattcccctaaagcacttaattcgttatgtcattctcctgtagggttaccaaaaatgggttttattttgcttatcatttgagtccaatctgggcaaacctttatgagtttttatcttccagtcgcagtctagacacctagctttgcttcctgatattccctttctcccatcttcttcagtcactgcagccacttcactggagctacacatgtcacatgcagagccgatttcaatctacctgatgctttggttcattctcctttcccgacatggaatgcagtataatcctccttttcaatgttagttggcatcctctgactagttttactactcaacatactgcctaaaattctccatcactcagtgaacaacaaagttgacatgagcatcagtgttttaagaggtggtttaactcaaacctatagaaaacttgaaaataaggtgtttttgaaaatgtgctcaagcttctattgtcttcatgttcaatttattatatgaccttgaagagaggtttatgttcaagaaataataatacagatctcattgtaattaccccataattatgcttcttttttctgaagaccatatggacctataaatgaagtcaatgagttaagagtagggagcattaaacatggtgaaaatatttttatttactgaaaaaattcaacagcgtattgtaaaatatttagtagaaaatgtaccagactgagaaaacatatttggagctccatttcttcagcttactgactctctaaaggcattcccctgtccttctctacagggaacttccatattttcttccaactgtccatttctagccaggggtaagcagatttatctttaagctgttacctgagtggagcctgtatcagttctactcatatcctattgatcagagctgctttgtatatccatacctcactgcaaaagaggctggcaaatagatgctctatctgaatatcaaggtatatatttaaaacttggggcctcttttattataaggagtaagaaagagattgatccttgaagacagccttggctatactaggaatgtcctacacctaaaaaaattagctggcagaacattagtcaacttccgaatagatgcttttaatgaccatgagttttgtacttttattgatagatcccattattatcattttttaaaaaaatcagccaaagttaatgaaggcctcttgagtcctgaggaaatatatgcacaaaatcccttcttgggatcttcgactgtttcttacatgctttgccttatagactcactgctattctagtcactcttccttccaaggacatgctacagtttatagtggccctgctgagttattgacccaggatattaacctggttatgaaaagctagaatgatcaagctacagatttggattattatattttgttgaacagtgcagttattttcatatagataaacatttctcttactgagaaatcattttcttctgggtactgttgagttcttaatttaatcagagaacattttatgtgtagtagcaaacggtactttcagtgagcttaaattttgatggggaaactgacagaataatttgcaaataaatatatgatatgaatttaaatagtgatgatttttggatctgtggctctactcaattatgtttctttcttgctaagagtttaagatattatcgaggttaccaaatagactatttatttagcacttttatatcagtgtttagtttccagaaaggtgaactgggtagccatgtttatattgtacaagtgaagtcacattgatattttattgcaatggaaacagtaagtggtttaaaaggaggaatggtgaagtgaaagaaattatcaacctgtttctttttatattattatctaaaactagtcatttttctgtttttctcttttgcattttttctcatttaagatcataagtgcctgttttaaaaagcagcccaatgagatgaccttgttaaaactcctgattatttctcagtatcgtcaattaaatgaaccccttattgtgtgcccacaatgtacaaggaattatatatacatatatatatattttttttttctttttttttcttttgagatggagtctagctctgtcgcccaggctagagggctagagttcagtggcgcagtctcggctcactgccagctctgcctcccaggttcatgtcattctcctgcctcagcctcccgagcagctgggactacaggcctggctaattttttgtattttttttttttttaaagcagagatggggtttcaccgtgttagccaggatggtctcgatctcctgacttcgtgatctgcctgcctaggcctcccaaagtgaggaattatattattattgtagttatgcaagttgaataaggtaatccttgccctcaagatattgaaactttaacaagggaaataagacatttgcacaagtaaataaaatacgataatactttaaatgtgatcattgtttttcagtattagtgttgatgcccattctacatcttcctctaaagaaaagaagacaatttgcaataaacctttggaaaggagttttgttgcgtctgtacttaggcaaatcgtgactaagaagttattctcctaatggccgcacatggtggctcatgcctgtaaccccagcactgagaggctgaggcgggtggatcacctgaggtcaagagtttgagaccagcctgagcaacatggtgaaactccatctctactaaagatacaaaattagctgggcatggtggcacatgcctgtaatcccagctacttgggagactgaggcaggagaatcgcttgaacctgggaggcacagattgcagtgagcagagatggcgccattgcactcctgcctgggcaacaagagccaaactccgtctcaaaaaaaaaaaaacaaaaagacaaatatataccagataaagtcctccaaaaaaagagccaggaaaagagaaaggagaccaggagggggttgcatgaagaaaatttagtattattatccagtattgccattgtttaacataatttgagttttaatcaaaatttacatttgcataatttaaaaaaccaaataaaatgtaaagagccctgccttatcattttcctaggaatttccgtgcttagagaaaacaccttcaactcctttagatgtttattctgggctttcatgtctgtaattctgggttttacatatatttcaccttgatttttaaaatgtagatattatctattgtcttcctcctatagaagatgaatgtttagctcctttcacctcctgcttagcaatccctttatttggttaaatcagtattcagagatttctttattatgactatataaatttactgtacagctatgccatataatatgatttgactatattttctttgctcaaaaaatttgtcttccttagtttttcaggactctctttggcatttctaggaaacaaaactctccaagggaactctgttcaagaaatctatcaggttttgttttttcccactagatatatgagtgggaagttcaggctggttgatctttagttctgttgcacagctatatccaagggctaacatttgctgctatactagggatttccttcccctgtctcctatgttggatcctccatttcctgaatcctacacgttctctcttcttggtttatttgtgtatttggtagagcacatgttctagtagcttctgaaaaagaatacaaggagggaagtaatttgaggagaaaattttgaatatctgaagtgtctttattgtctacaagtgtctaaacataaagaacgatttgaaattttactattatatgaaaacttttcattaaaaaaatttaaatggttgtaccattagctgttagcaatgttaatcagattctttcttcttttctacttttttttttttttttaacgacctggaagtttttaccatctctatatccctgggcactcagtggacccttttgcctatcagtgatggttcttatgttctgagaaaatctgcaaacacattcatagcaacatctagactcatgttcgaccaaacagttggacaccaagcctagccaagttgatgcataaaatcaacaatcacaagcaacctttcacataatgcctgtttacatacttgttgagtccagactttctttagtttaacttctaaaggaaaagcttactgcatcttcctgaagtgtaagagggacaacttcctggttggggaaggtatttagcacaccttatatctgacttcggaaatctctggggctttcaattccaaacctttctgtctagagttacacaacttgaataaattagcttattgtcgggctctccactgcaagagcttagctttttcttataggtatctataattgattgtcatttttctccttctctcttttttttttttttttttttgtttatttcatctctggggatttcaggagggaaacattattcaatctaccatgttttactgacaatgttcccctagtgtttttgaggttttaatcttttcagaccaaatctttgcagacatccttgagccctctcttttccccacaacctttgtctcatctaataaaaccaattctgctgattttaccttcaagtatatccagaatttgaccacttcttgccacccttacttacaccagccaggtccaagccaccttcctctgttcctggactattcaagtagcctcctactcccctttatctttcttccatcacttctcaacagacagccaaagtgatgctgttcaaacttgagtaacatcccatcactccaccttccatttgcttttcaccatagctaataagaaacaaagttgatattctttaataatcctcatggtctataatgtccatgaactctctgacctcatttccacaagtcttcagatcatttcttcctctccagccaacaagcctcattgctgtccttcacaactgttcaatgctctatctcaggcaggtataaaagtacctccatagcagtgctccctatatattttctgaattaatggataattatatttcaaaaatacctcagtggcattctcctgtttttaggtgtgagcctagcaaaggtctgtggtgtttttttcacaacacttacgaaaagcgttgtgttcaaccttgcaaatgaggaaaaataacagtgacctaagtatcatatattttttaacaaaacaagatatagtctgcacatattcatagcccacgaaaagagcaatgtgtgctttggggtggacatttttttattttttattttttattttttttgttttgcttcagaaattccactttaatgtttttttttttcctggttttatggtctcttacagtaaaacttgcattgaaaagagaaacccttatcctgaagtatctttatcataaacagatgtttgcagtagccagccctgcaatgtgcacagtaaaatgtgctgctacaatctgaagctttcatttacttatttaaacatgtctgagagacctagatcatataccacaggggcagacagcatgctggtgtgtgagcagtggggcatggagggagaaggatggggtaggaagggatgagtagcaagcttaaggacttctgcctccctttcatctgtgattgcaaatactgctgacccatagtagatgactgcacatagattcttgtcccactttcctaaaaaacattattaaggaaggtgcatgtaatgaaacctcatgtattattaacctaaccttactacgaatgtacaaggaataggtttaattcaagtaaaatttataggcaatttgttaaagcagcagtgcacattagaaggtacattagagacacattggttttaatatgccattcaataacttgaacagaggttaaaaatgctgcttaacctccattaagtattttaaaaatgctttaatttaaaattatttggagtgtgtgtacatatatgaatgtacacatatccacactaataaatataacactaaatatgttttcccagttccctttttcagtgctggatgaccttataatgttcagcagtaggcacttaatcagaggccaggccgaggaaggcagggaaggatgtcaacgcatcccgagccagtgacccacccttgtccttgagaactagaggcagagagtgcatattgaagactctgtagctttggaataaaacaaaggctaatttataatgaaaacagcttcctatgacatgttttgtactaatagggcagtgcctcctgcttccccctagtatttacttttggttttcttttacaattcataaaacaaagtatcttgtttcattaagtagcacatcatatttattaagtaatgagctcataaactagaattgtgtacaagaccctgccaatggaattggaatcagatgctgatgttccattaaaaatcaatgcatcaaagttgatatccaattatgccacatttcctagtgtttggtgagacaactttctaggttaacatgtttttcacagagagacctgaatctaaaagtaagaacctcttccttgataaatcatcaggaaggaatcttgtcacaggaaatacagaccacaatcttaggtacatctggaaaacaaaaaaaagtaaaagacactgataagaaaaatttctctgtcatagaaaacttgctaattgacaattacaaagatgataatagataatgtttactgagagtccgctgtgtgccaggctctgtgataaggttttgcctgcaaactttcatttaatatgcacaatatttctaagatggaggtgctgggattattctcattttaatctaattgggggaatgaaatctaattaagtagaagagccatttataagtccaggtccatctgactccagaatgtatactctgaaagagtggaactttttctttttctttcttttttttttttttttttttaagacggagtcttgctctgtcgcccaggctggagtgcagtggcacgatctcagctcactgcaagctaagagtggaactttttctaaataactaactcaatatttatcttacacattcacacaacaaatatttgagggtgagttagataaatactgtttatttcatccactttcaagcatacctcaactcatgattctggcttactgcttcacattctgggatacctcatttgttgttcaaaacccaagtagtaggcataaaatgaaaattaacagagtcctgggaaaccacagagttcaaataatgatgaggtaaattgaaggggtctagaaatggaattatctccgagaacttagttggagaaattctggagatggttggaatggcacaggagacaggctttagagcatgcatttgataaacactgaatgggaacagagaatataagttttgctgtggattttgaatatgcatacacatacatatattaattataatctccaagatgtaatcagagttgtcattatttgggttatttgttgttattggatttgattcttagagaatatgttaatgagggcctttcatgggtattcacataaatagaaaaattggattatttatgaaacagaaaattccaataatgttttcccttacatgagcatattattatgtcctttgtttaagagctaagatatagttttagggtgacattttctttctgcagctctgttccatctgttgctgtgacgagcactatattttaaatttattgtgtctgatccatatacactcctctctagactccctgataggacaggccactctgaccaaccactctcatgactcacagatttatgtttaccattttccttttcagtgttaaagggatcatctcatattttagaggatagaagatatttatccatctatccacccattcatccattcagctatctatccatttcattcatacatctgtttttcaataaacatctattgagtaaattaccagagactatgttggtgttaaggtatacaatcacaaatatactaagacattgtgatttagtaggggaaactgactcacatgtaaatgtatcacaatgtgatgagagccatattagaaatatacaatatagagaagtagtaaagtgaaggaaatgattaattcttgaaggatgaggggtcttaggaacttagagaaaatgatttctgaactgacttttaaaaggaaataggaatcagcaagctgctcaagaagggagtagcagcccagaaaaaaaaaataacagcagaacatttaaagcatacctaatttaattgaaaaacccttaaaaattgttttaaaaaagagaaattataccttgggatgaataatattaatatttatgtattcacttgatcaagtctagaagtaattttagcgtgattttatataaaactaccaaatggaggaaaattattattgttttaatttgaaaactaccatcatcaactatactgaaatatagtttacaaacaatacaacaatattgaaaatattgattcataaagccattaccaagatagtcttttgttgcatggatataggtgagccacccatccctccccaggctcttgtgtaactattatgtccattttctgccttaaggtgagagtagtttcttctaaatgtcttacaattagtgcttagccccagcattgccctcctttcttgaataaagcctagaggttacacttcttttctttctccctctcaagaccttggcaaagcctagttgttcatggtcctcaggagagacattgctgggaaatgggctcttcttttatgcccaggacaagtactgtgctatgcaaatagccgctgcaggagataataccagctgccttgctaataactttgaactctgtagattcttctcctaggcaaagccacactattttacaatatgggtgactctttgttttagctggatgatacatttttttccacttgagatttgtcatgtctaaaaccaagggtcagctaaataatatgggaaaataataaactagcgagctgatttggaccatgtatatgtgaactctcagcactacgtaatgcaaggtaataatgttgtcctaatgaccatgcttaagaatgtggtacaaaatcattcatggaatgaaatctcaatatgatcagttacaatgctacagatatataaagatttggaacatgaagaagagctaacaaaggggtatcagaaatgcattacattaaagtaaattgaggtcagttataattaagccacattcaggagttgatgtttaagtggaagggaagggaaaagattgttttctatagttggaagtcataaaaggaggtaatggtctagaattaggcacattcaggtaaggcaagaggtaatctttaagcaggaagttacctgagtcatcctaattagaactgcttaaaaataggacagctaaaatactggtgggattaacctttataatcaggctcctgagaggaggaggggaattaaccccaaggcaaattcccatgcagtcttttcctggaagccctaccttcactttcagtctccctaggtgctttagcatctttttagttcttctctgcttgtacttctgatttttctgtgacattctttattccccaaaacttggactacccaacttctgcaccaaaatgctatcccctacttgtacttacaggtttatctaatacatcatttcttctaaaaatcacccttaatttttccaaattctctgtggcttggagctattgcagtaagtctaaattaattctacttgtaagtatctgtgctaatgggtaatttatccaaattggagagctgttagcacattcatgatgccatcatcatggatttaagggcctagataccttcacaggaagaaaaatacaaagaatcacaaccacagtggccttgaatttaaatggaagccttctgaatttgactttgatcatgtgatgaatcaggtacaagaatatatactaattgtcatggccatgctctatttctggatatgtatatataagggaaattgctgtcaggtggtacaaataaacaaatagcgtaacctggctgtaaattatgataaaaatgatagtattagttgatttccgccaactgaatggcacatattttgagctctttcttttcctctcattgagcacaatgttttctattttgctgcccttgaaactttgtaagacagaatgtataggatctaggggaaggaaaaaaacccaattgttggtaactataagaaaatggcttgttttcaacaagagcctggaatgagttttagagtatcctaattactttttgctgttccctatataatagataagagaatagattcactttttgctcatgctctccttctttcaatatcattgctattttatgaactttaaattagtgtcatgacaattgtacaattcatttttatttgctgtaactgtattcattagaatccttctgtgatccttctaccccattgtttcagtaaaattctttgcagcattttgcacgggcttgtgtgtgtacccatgggtctgtgcatgtgtgtatatgtatatgtacacatacatgaacacacacatcacacaacactaagaaccatttctccctcatatgcctgctccacattcaactgcctgataactttctaattctataacagttaacttccatctcctgggtctgaagagattttaagtaatttgaataaacttttgaatcatatttgtatttctttcctttttccataagaaaaaaaatatgagttttagaggtaagctaaagtctctaaattctgcaggctttttttgtgtgtgtactacttgcagggctcacagcctgtttaataattgaactcatttttatttgttcatcgaatgtgtttggaatgcctactatgtgccaagcagtgtactggctgctagggagacaatgatgaatgaagcagatgggttttctgcccttatggaagttagattttggtggaaatgagattgattataattttcatgaacacttaggaaacaaacaggatgctatgcatttgtaacaggtatacctagcctggcctagggaaagttgcctgaggaagtcacgagacctgacttacatgagtgaactgagcaacagagataggtcaaaatcatcccagcagacagaacggcccatgaaaaggcctttaggtctcaagaagaggaacaaatatgactgcaatggactgagcggggggatgagccatgagctaaagctagagacgtagctgggacctgactgtaggattgaaagctgagtgagagatttggatttatttcctaaagggaataggaagtcatcagttagtttcaaatagagaagtgaaatgtccaaactgcactttggaaaaagactgctacgaagaatagattggaacaggacaagagggatgcaattagaagagatggcctccgggactgggtggtctgggtgtaaacctgggttttgctatccattaactctaccattttaggaaagtgtgttaaccttctcaatcttctgttttccaattgacagaatagatgtaataataattcatgcattatttgcatttctatgacaactaaatgagatgctcaagataaagcccctacagtagcatctagtttgaagtattagttataaaaaaagtggttggtgactttatctgggaggtcgtagcggggatgaagagtggaaggtttaaaattgttaggaggcaacatccataggacttggtaattagcaaaatatagggggtcagagaagtggaggatgcaagcttttgttttagtaaaatacagaattagtttaatttgaatttcagataactttttttagtctgagcaaatgctgcatgggctgcacctttgctaaaaaatttcattatttgttagaaattcaaatgtaactggcttcctatattttataagtctgccctaccaaaggtacctcagtgttctaggcaaagcaactgaatgactggtaatatctgttggaatggagctgattagaggaggtcaagttttttgtagaaatattgaaatattgcatggtagattttaaatacattgaattgtaggacctgggaggcacccaagtccaatgtagataatttactcagtttttctttggtcataattgacacactgaaggacagatataaccacatttgtattgggaattagtgccttggtagagtattctgtttttctgtgtaatcaattattatgctttaaataaaagagtggataaaaagtatatataaaacttttaatttctttatttctaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaaggtacatctttataagctttaataatttaactctttctttagcaacagttaactttttttggcagttgcaaagcaataacttctgtaaaaagtattttttttgcccggcttggtggctcacacctgtaatcccagcactttgagagaccaaggcaggcggatcacgaggtccgaggtcaagaggtcgatatcatcctggccaacacggtgaaaccccgtctttactaaaactacaaaaattagctgggcaaggtggcatgcacctgtagtcccaactactcagaagtctgaggcagaagaatcgcttgaaccgggaggggtaggttgcagtgagccgagatcgcgccactgtactccagcctgggagacagggcaagactctgtctcaaaaaaaaaaaagtgtttttttgttattgatatgttttttgttccgtgacatccacatttacttaatgtatgctaatctttgaatatttcctagagtgggttgctatatattgatagatgtggcccatcctagcatctgggaatgttgaatgagataaaatatattttctctcaaaaagctgagagtctggatgtggagaaagacaggaaaagacatatctgaagaagaaaatacacatactcatactttctctctctctctctctctctctctgtctctctgtgtatatatattatatatatatattatatatataatatatatatatatatgggatatatgtatgtgctttgttcttcattgcccttgaatttattgcatatttattagttcattgcatctatttatattttccttgcgtttctaatttagctttaaagactggcagatgagaaacatagctttgtattctgtgatatgatttttttcagtatgtaaagtatattatgaaagtaaatcatttttcaaagttacactctctttaatattctacttcttattctctgggtatctgtggccatttgccttcactcatttgtgtttattgctgtatttttgaagatgtgctataatgccaattctgtgtctgtgtgtgtgtgtgtgtgtgagagagagagagagagagagagtgagattatgagcttgtctaaagttcagactaaatctatgaattctttgaagctcctatccctgagaagctagtagtgtgtgctgaactcagaaagcatgtaataaaatgagtcaaatctgtctctcaatatgtgtatatttataaatctaattgctaattatttcagggtttgtgattatctgggctcttttaaactcattgcccccctgctgcctgccttttggctgttccactcctcattaacacctccattagagggtggacaggtgacagggtaattactgaaaaagaacttaaactagttcattttgactttcttttaaaatttgatgtgatttttaaaaactacaaaaatcatttaaaattttattaaaataatttttgttttcttgacatacatgcatatattttaatctgtgacgctctacttctatcaccgtagaaatgttaccttgatggtctgagaccattgtgactcttttctacagatgttattataaatcatctaaatgagtatacaaagcgcatggtacagtaaatagtaaataaaaagcactgtcaggattttgatagtaaaataggagccagttactgcacatactagctcctagatgtaatttttttgaaataatattctacagattccccagttggaactcttgggctggtttgtttcactcctggccacctctgtctttttcatagttctgaccacatttaccaggagaaaaatatcttccccaacccactgtcctccttgcaacactcattcccatcagtgccattttgtgacattcaattacccatttttgttctactcatcccctttgtcagtcttcccagggttatcagcaaaacgcctgctcagtgacctggggatgtctgattgtctcagctttttcacttaactttttttctttaagtgagatctgattcccttcattacactgcttcctctaccctacaatgttcttaaattcgtggctgagccttttaccccattctgttcctctcccattatctacccatctcactctcactccccaccttactttagtccaggaacaagaattgcttaataagtactgttccatcacctgtcactctgcagtaggcctgactagcactggagctagattccctgggttagaaggtggatttaaatgtttacataaattgataaggaataggaaggaccaaagaagtgggtataagctacatttttagaagataccgaagttacaataaagaaagaattcagtctaggcactatggctaactcatgtaatcccagcactttgggaggctaaggtgaccagatcccttgagtccaggagtttaagaccagcctgggcaacatggcaaaaccccatctctgtaaaaaataaaaagttagccaggtgtagtggctcttgcctgtagtcccagctacttgggaggctgatgtgggaggactgcttgagactggaaggtcgaggctgcagtgagtcaagattgtgccactgcactccagcctgggcaacagagcgagaccctgtctcagaaaaaaaaaagcaaaaaagagagagagaaagcagacttcagattcgcaaaaagaatgaggggcaggttggagtctagaaaatagagctaaagtatgagaagctgagtagatttctaaaaatatgaatgattcagattaagtgtggggttttttttttggacagagtctcacactctgtcgcctaggctggagtgcagtggcgtgatctcggctcacttcaacctctgcctcccaggttcaaaagattctcctgcctcagcctcctgagtagctgggattacaggtgcatgccaccatgcctggctaatttttttgtatttttagtggagacagggtttcaccatgttggtcaggctggtcttagactcctgaactcgtgatccgcccacctcggcctcccaaagtgctgggattacaggcttgagccgagtgtgtgttttaaacaaaaagatccacaagttttatataaatgagtttggatatctttacatattagttggctcctgttatattgatgggggtggtgagattacctttttaaaattacaaattgtccttggaaatggtcgcacttttcttccatccctgtattagtccgttttcatgctgctgataaagacatacctgagactgggcaatttacaaaagaaagaagtttacgggacttacaattccacatggcttgggagacctcacaattgcagtggaaggtgaaagacacgtctcacatggtggcagagagaagaaagcttgtgcagggaaactcccctttttaaaaccatcagatatcgtgagacttatttactctcatgagaacagcaggggaaagaccctaccccataattcaatcacctctcactgtgttactcccacaacacatgggaattgtgggagttacaattcaagatgagatttgggtggggacacagccaaaccatatcaatcccctttgttcttatctttccagttccaggttttccttttcagagggattctatttttctcccttttctaactcctgccattattttaaactactttgacatgtactgatgcagttctttggcctcttcattcattccccactccagcaacccatttccatggctacaccctggattttgtgatcacttataatttctctatttctcaaatcttcctaatcccatgaatgctattctatggatatatcacatctttccaattccaattcaccctggaagcctcacataacctgctccttaacttctcttaatctttatcccattatccctccttaatcctcttttgatcaaccccatccctaacttcactgtcttctacttctagcctgaggcaaaacctttttaattatgacccttttgagtacctgattgtgggctcccttctgctgtactgtggggtcagctccagagacgatcaccctacacctgccctgatctgtgaggacgtggggaaagatcatgtgcctatgctgatctgaagcactaccatgtatgtacttcttatcaatttactttctttccccctttaaactcctaccagtctcctcagttttaattccatgctcttgcccttgcagataatctggccctctgctcatagacaaaataaagccagatatatgtatctccagattatcttttctccacctccagcttgtctacattgtcacacatttttaattttttatctagtcttagaagaaaatcctgtgtatttttgcctaaaaataacctgttcccagtccttgatatgatcccttcctgttttcctactcttgttcctccattccatgatctttgctccatcaaatcctccctttattttaactcaaacatctctctataggtaatatcataactgcctacaaaaatgctattcattctacaaactccttcctttgattctgccctgctttatgagccctgaaagttattgtctaatctctcactcttcattcacttactaacatttaaaaagagcactatgattcaagaaaacatgatttaaaaaataaaagatcagattttttttcttcttcattttgtttctttctcattcattctttattcaccatgtgtggtacatacatgttagcagaacatacaagttagcagaacttgcaacatgcagacattcaagaactagttatgtgactattaaattctcatccaaatcaaagacaaggtctataaagagatataataaacaaaaatgggttaaggaaaagacagaatgagggaacaggtttcactggtgggaaaaagggaggggtcagtggtgctttccacttgagtccagtgagaaggtcttatttgatcccttgaagggtgacatgtgtctcctgcagttggagagaccagtgcattgatatctatcttagacctggcaaatctaactgagaagagacagtctacccaggtttggataggtaagctagaagacagtgccctgcatatcttagactcccagagttcatcatgacaaggaagactacgtatttctcatgaccggatgaagaccacaaggaagaaagacagggtaaggttgtcttagtctgtgctcaaagtaccacttagaagataaaggggcctgtgtagaataaaggacaagattactgtggactacaggttaataagcaaccagtcgaaaagaaaatgcatctgactgcactaaaacaaaaggtgagagatacctaatggtgagaaagatcaatgaagaagtcaggaatgtaccactgtcagtgataagtcagttttatgtatatgcaggaccagagacaatagactgctttgggtggttctagtccaagtgagtttctacccttcctgcagcctctacgtgagggaggaggctaaccaagctaccttctctgattatagacttgctgcctttatcatgtcctagcttgatgaaaggaagagaagtatgttcttgaaaatgtctgttctttaaataaagattggaatgttgactaatatacaggattagactttctattttctgaattgaatttgtattttgcaatgtaaagtaactgtaggacattctattgcctgagaaagaccagaaaagccaagtgactaactcattttatatccacatggaacatgggggaattagctccatattatatgtttaaagggtcagtgaaagacaaaaataaaactgatttatgattgcttctcatgacttatggtttctcaatgtgctggtcatttcattgttcccatttatttcttaaaattacctcttcctttggtttccaagattctacttctcttatttgttttctaactctttttttggctactcctttttaatatgtcctttcaatttccacaactgtgtccctgatttcaaccactacatacatgttaatggctttcaaacacatgatcacccattcagatgcctgccacgcactctaggcctgtagccagctgtctctctgagttttacgcttgcaagtccctcgtgcatttcatttttaatatagtcagcacagaactaaccattacttcctcatctccacccaaataaaaataagtcttatgccatctcatgctatcatcatcttggtgaaaaagacgtaaaacttcaaataattattcaagtccaaacttcccaagtttgagtggggcttagattcttctcaggtttggcagaattggctctgttgttgagtagaatgagtctacaggctactgctggaaagtgctatggaaagcaagagctactgtatataatgcagcttctctaaaaagaatagaaagaataaagcttcccatggccatatgggacccaaggagatcagcaggatttgtctcttactaaatcagtcgtgtggaatgctggtaacttgacttgaccctcctatcccactgatgaattcagctgtctcttttcacttcaacattgataatcattacacaggaaatcctgtagcacagaagggcatggagaaggatattttaaaatgtgacaatgagaattgcttgagtttggacttttgttcaacattgaaaagagataaaagtgggttctttttaatgtttttccattcctcttttgaatgataccgttcttgaatctttttttgacttctggttgttattgtatatacaccaacattggctatattgaaaatgtgtaacaattgactaagatatatgggattccatcaagtataagaaatttttgttttttaaaggaaaaaattcacatgtaatgtaaatatatacagatatgcagtataggaaaacagctatgtcctaatgttaaaacaatgtttttgaaaacaaagtagattcaaaatcatttgaatctactttgaaatctaggcactgtggtaggttattacaaatagaaatgtttacatttataaaaattacattccaattataacaaatggaaattaaaacattaattttcaaaatatacagtagattataagtaacttattattatgaaaggggaagatacaagtatcatattatttcttcatcaacttggaaaataacctcacttccttatctgcctggttcacatattccttaccttcttcatgctctatttgttggatatagcaaggtttgctatattgttttctcttggtttatttgctacacagttttttgtattcccaagggcaaaataaataaaataaaatagacctcggccctaaactacacaaccaacaacaaaaatccaggcaacacaacaatgactttttgtgaccaagctggaaaatcatttgcctgtttccatctaagtggtttattcttcaaaagttactgaccagaaaaagggggcatgtattttaaaaagctgatcctagtgcaaacattactccatttacctctgacacataaagcaaacatgatttaatcagtatcgaaaacaatgaagcaaaaaaaatctgcccactgaaaaatcaataatgcaaaaaagtatatagtgtttgtctaacccaaaaacaatgagacaaaaatgggccatatttaattcatctcagttggtagtggagacccatatttgacaccctgcacttactggcactgtcctcaagttgacctgtgactatgactactctcccccatagcccccaggactgctccagttcatctggtaccccacagttttcttacataacaaccacacatcacaacccccaaaagtttcttccctaatgatataccctctctatattctatgttaccttgttttaagccttaaggagttagtggtatcactatttgtcccatttactagctgacacacactgaagttgtccatagagggtaggacaccaaggctggttagggagaataaaggctcagacttctggagcataaaatacagggaagttcttctatgcccagattatttttggttttactgcaaatgttctacatttcagcactaggttatagatttggtccagtaatcttttcacaggcctttatccgattgatctcaattggtcttttctctgagaaccaggtcaatgacttcagatgaaagcagataacttccttgtcaactgatttccttttatggtgtgataatggaaaaattagggagtgtgcctcatagattccctctcctcagtgactctttgtcagacagctggctgtcatctggggtgacagggtaaatgggccacaagcctgtcatcatctggcagccaaggcagggctttctcacaaggcagtggcagatttccaagaaagaaagcagaagcatgcaaagacacttgaggcccgaaccgtcaggatgttacttttaccttattctactggccaaagcaaggcacgaggcttaaccatgtttggaagtggtggggaataaacagactctccttttgatgagtagaactaattatacagttagctgcaaaggacctgcacagagggaaaggtgaagagttgtgatttttgcaatctcctatggctgccaaactatatattctctcttagtatagatgatatatgatctgataagaagtatcagtttttatatattagtagcatttattcaacgtgatgtaataggaataacatgcaactggacatcaggatatccaggtttcagttttgtcttttccactagaccagatacagtagcttcctattattggtggaataaattatctcaaactcagtggcttaaaacaacatgaatttttattatcttatagttctggaaatcagaggctctaaatgagtttcactaggctaaaatcaggcctgtgtttcttatggagattctaggaaaaaaaaaaacatttccttgattttcccagcttttagaggcaacctacaatctttttttttttttttttttctgagatggagttttgctcttgttgcccaggctggagtgcaatggtgcaatctcggctcaccacaacctccgcctcctgggttcaaatgattctcctgcctcagcctcccgagtagctgtgattacaagcatgcagcaccacccccagctaattttgtatttttaatagagacagggtttctccatgttggtcaggctggtttcaaactcccaacctcaggtgatctgcccgccttggcctcccaaagtgctgggattacaggcgtgagccaccgcacccatcgtacattctttagctcatggctccttccttcattttcaaagccagcagagcagtgtttccttggacctctgcttatgtccttacatgttttctctctgactcttaccctcctgccttcctttataaggaccgtagattacattgggcattcttggataatccaggataatctccccatctcaaaatccttaaccacatctgcaaaattccttttaccaagtaaggtaacattcacaagtttggaggattagaacttggatattgttggcgtgggcataatatgacctgctctaccagagttcagcaatctatagcctgggggtcagccacatgtttatgtaaatagagttttattagagcacaccaatgttaattctttacatattttctgtggttgctttcctgctacagcagcagagttgagttacaatagagctcatatggcctgcaaagcctaaaatatttactatctcatcctttatagataaagattgctgaccttgtaactagatttactgtcaccttggacaaattagtctcactaagcataatagaatcataactttatagactgggaaagaaccttaaaagtaattttggttaaactctaccctatacatttctctgcgtaaatcaccttttcagaaaaactggtgaatggccattcagcttctgctccaaaacatggaactaaaaggagctcactgtctcatgaagtagctcatgtttatttcaaacagctgtaattcttcaacaaatagaaatatattatttatattgaccaaaaagttgcagtcttttgactttcttgcctagtcttatttatgccttctgagaccatagagaataagtgaaatctctcttctatctgtgagcactttaaaaatttgattctgctatcatatctgaaagttatttagttatttgcataaatatgtggagtgtcaacaaaggagaaagagacagtgttctcagatcagaaccttgctgagcaagctgcctggacttagctgtcactattgcatggatgcaagggagtcactgcccctggtccagcttttatgagtttctctatttgtgcctgggaaattcaccaaagagggtggggttgcacactgttaacgtctccctttcagatgaggcactcgtatttccttgttcaataagccatgtaaatatggctttcagttcacacagcgtggatgcccaagcctcaaatccctctcctataattctgattccatctccaagagaattcagatgctgttagtagtctgtaactaaagcgaaactaagaagctcaatgaaaccacagctcctctgttaatcggggaaaaccaaactcctctagagggcactgtagcactcaccgaattctgtgaactgagaacactggtttaagagaatctgaacagataccagctcttaaagaaaactgtccattccctgggagtgaggttagccagggggacagagttaagccaataaaaaggggctcaaaagagctaacttgttactagagctacaaaccatgtttggattaatctccggtgtcctatcctaagtctaaagcttccctggtgctttattcactattaattcctgtatccgacaatatttactgaatccttactgtgtgctagcctttgtgttagggactgatggaaaaaactaagacaaaaacaaacaaaaaaactctgccgaatttctccaatttgccttgaagtctcattctcttttgtttattaataatccttatctaaaatcccttagcaattggagatctctttctccttcgttctttatgttgaatgatgtcttcatcatccccattagcaagttagaagaccgggagtaactttatacctatcctcccttctcttttcaattcggcctcccattctaccaattttacttaacatttctcaggtctatcctactcatttccattgctccttgccactgccccaaggtagcattatcttacttctgctcacctttccaggtttatctatcaccatttctcattatgaatttacatccaggagtactgaggtgcttgcaatttcataccctcttctgctttttcttttttttctctatttttgcccctccccgacttccctggcttatttctactcatcttttaacgttcagcccaagcatctcctccaagacttctacttaaaattacccttcccatcccttcttctgctaccagactagttaagttgccccttttctggacctttagagtctggatacatctttattaatgctgtttccgttttttcttgcatacgagattgtgagctccttgaggaccggggcaattctataagattcatctctacatccttgatgtttattccagtcctggaacatagctggccctcaatgaatgttatttatgtcaatcaatatttaaatcaatttgatagtacccatgagctgaggccccatagagaggaggggtgtacaaagagaaatgtcaataaattgacctatatatcttgggatatatctctgggcctcctacagcagttctccctcagatgatgaattttctgacaatgatgtgcattactgaaacatattcctttcattaatagttaggtttcaacagtaataattaggataaccatttctctcactgtttccacaactggaagaaattcctaagaaaggaaggtatatgaaatttgtgatgtaggagacagaggccaacttctttcccattgtaaccagcaaatactgagttatgtaagggtccaaagagaactatcatagcaaagtgctggcagagattagtgatgctttactcctgttttgtttaccataatgaactggtcaataaacatcacaaattgtttatctatataaatcttgacagattactctttatgaaatccatttagcaagcgaggttttcccataaggatgaaaaatgaagattttaaacagattgcgggagaagctctggctgtaccaagagagtcagtgtaataaaggtttctttatattaatattacaaaaaccatttatcctggcaaaatcaatattgcaattcatcttagtttggtgtttctctttctaagcttaaaatgtcttttcctttattatgtataattttgttttaataaatgtgaaatatatttcatttaggaggtactcttgaggagggataacttataaaatgacatcaaatttgtagcttatttgctaaagagtcttggaagtgtttaaaattatatttgagtggctgagaaatctaaaggaatcattttgcttaatccttaattacaaaattatccctgtgtcctttggggtaaaaacaaactacaattttcagaaaagtcttcgcttgtgaacttcatttaggaaaaattctctcttactgaagtcaagtgattataacaagtcagataagttgactataacaatggcttggataagagactataaaatcaagaatagacacatttaattgctcaaaacattgcgtgctttggctggaagaaaatagaactacatcaaggaacggaattatgttatacattggaagctattactctaaatgtactgtatgtaaaataagtgtgattgtctcatgagtgaatggtaataaaaactgaaatactcaagagacacttattcatgagtggtgcagttacacatacatatatacacacacacacacacacacatacattgagagaagcttttctcttattgtttatgctcactaatattatattaaaagcctataaacaatagactctacataatagcctataaagaaattaagagcaaatcaagtatttttgcatctataattccattttaattataatacataattttcttcagctctaaaacttaacctaaacaaaacatctatttgaaatggaattctgatgtaatgtgtatagataaaagacctaatatagttgtttgaagggggaaaatgtccttttatcatgaccataaaaacggcaaactacagtacagtggttttcaagaaaaactgtactttatttattcccaaggggatattagtccataaaacaaatttgcagcttatttggcagtcttagcttttatcagcctttttaagggtgttgaatgattacccaagagatcacactgtaaaaatggcagtggggaaaagtaactccatccgttcagcatctttattagaatatataggtgaatccatttgatgttgttttaaacgtaccacaaggagagtaccttttaaatggtgagtggtcttcttacatgtgctgttttgcttctctaatacctcatggcaccaacgttgcttatcctaattagtgccattggcataggctacatgtttgaataattcactgtgaagaaacaagttttagtttctatcatggcaaaatgccactactggtatttttacaagcaactttgggtccaagaaatttaagttgcactaaagttatcttactatatttatgtcattagcatcttttcataaatcagaataatgctgtattctccaaccattatggataactaagtttagttcataaaacagaaaatgaaatataacccatattaaggcatcaaaaatatttgaacctgtctttctcaagcaattttcttagtgaaatttagtcttcatcgaactaactatagaattttaagatttttagggagagcaatgatttacccctgattttctatttcgcaattggagagtcacttgaaaagataattttatgggtacctaatctaaatgtttagctgacaggaacactgcttttgtaaaagcaaaatttacagcattcttaattgaacaactggattcaaactaatccataagatatattgtgggatgtaaaaaagcaatataatatctttttttgctattaattagtttataaagagaaagctttatacgggttttaccaggaacagtagttttataaagatcttttctattttcctttattttatgttgattctttgtttgtttagctcaagcattcttttcaatatattggctaaaacaagccgtcttactctacaatgctattggtaggtgtaacttatactatgaattattaatcaaaacactattctctttgatggtttatttgccttgttttcagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaagtaagtgaactctggttcagtgctggtgtgtgaagcagcatcatacaggggactgcatctcattgttttctttctccatttagaacccatcagaaaggcttagtacaatgtgaagaacgtaggtaagagatggaaaaaaatacactgaatgaaatatgtctgcttttccttgattagacaattggaaatggtaatataattatgttcatggtgggaaatttacaatagttttttggagtgaaatcaacaatgaggtgattaaagtcctaggttttcccagaccaagggtcttcccaggacacaagacttttaatggtaaaatcaggactatattggttaaaccaaaacagttggtcaccgacacaaagacatttccaggtaagttatttttttttgacaaataaagggtgaattcttgtttattatatgtttgatattcttccatcccccaaattttgtgggcagtattataccattagttgtttatcgatattgtaataattagtatcattcgtcacgcatattattcatcccataattcatgtttctttctactttaagtttcactcatttaaatatctctcacatttatatttttaattccttaaagcctaagattacatgtaagtatcttttgacttttcaacatcgcttttcagtaccttgaattgacctcacaaggtcacctgcagttctacaatttcataacatattgaccgttttcctatatttacttcaagatcatacatccttaccctttccagaatccctaagaaatgcctgctgggaacatgtggtaggagccctctacaacatattgtgctatgcatattctccttggggtgtcctgagactgtcatgagtcacaatgataggaaacgccacaagtcatgacagatcatcacaaaccagcatgcctggaactctgctatctacatttaaggggggagggagaaagataagtaatgggatattggactccacaacaactgtactagattttgaggtaatggaaagcaggatatagctagtgattaagaagacgtattcatattttgtacctgtgtagtttctcttcagcatcccgcatttcatcagtccctctggatttcagtataagtaaaactgtaggtatttatgcttcttttgggaaagaactgtcataattcctttcatgtataaatacagtctaaacataaatctggacttcattggccacttaattactatgtgtcatttattgattagcaatacaattgattgctttgtatgcaacaaaaattctagcatattccttttggatatgagttatggatcgtcatttataatggaattacaatacctaatcttagtgatttctgattggttctgccactaattttgtgacaatattggcacctgctctactttttgctacctattccttcttgcatttgagacatagtctgggaattatctctcaggcaaaactggatagtcatgtcactggaaagctagcctacaactcttagtagtggtagacatttaattttatgttttattaactggacattctttccaagtgtttctgatttgttagaatttttaaaaactctcacattcctaatgattcttccctggacatattccttttggttttttatctctttaaaattatgatatatcatactgagcacagttcttcaactcttgtggttgttgctgcttctgttttaggtttttatttaacaaaatttttgaaacactgtgtaaagttggaagctcagcatcagcagaggcaatttattagaaacaaatgagacaactttcctgccttcagaggaggtcaaaacatagctagagtgatggacactgataataggaggggagcagaaaaatgtaaatggtgggatgaggatgaagggtcccagccttctctcctgttccagcttgattttcacatggtacttgtgtttgatcctagcagaagccagccagaacaattggcttcacaaagatatgatgaaattgaaaggaatgtagtgctatctattgctgacacagtgaactacctctgactagtatttgtctctgtatccaacagatgtcaagaaatattttcatttaaaattaaaatttctcatggtaccccaccccctacacagtttgggaactgcaggattataaccctcattatatcttctaggggccactagcaataatttagtaatatcatctgtgatttttatttttggtgggctgtcagggtgggaatcctaggatgtaatttccaaaatgcaagaggattgaatgaaaataaagtagttagaccttttcttatagtaaatttcccttttgggtgattcacttctttcctttaaatattggtatcatgctttcaaaatgatagtcattcttcttgataggaagcaaaacaagaattaacataaattaaatagtcctattttctgtatgctttcctagcgaatgatattctagttagttcaaccatctatgaacctaactaaaattatacacatacacacacacacgtatacaattagccacttattgtttgatagtgtttgtcttcttgacactattctcattgttatttattcatctttatatccacattttttctttatctctccttgccagagagcctcttctagctctccttttattaacagctttattaaagtataatttacatattatatatttaacaattttaagtatatggtttgatggattttagtaaatttagacttgtgcaatcattactataatccaattgtagaacacttctgtcatttcaaaaagttcctttgtgcccatttccagtcaatcatgactcccacctctagccccaaacaactagttatagggtctttgatgagataattttgcctttcccatgagttttatataaatgaaattatacaacatttagactttttgcaatgtataggcttttgtatctagcttcatcttaacaaaatgtttttgaggttcagtcatattgttgcatgtctcagtagattcttttaattgctgagtagtattttatggatacactatattttgtttatccattgatcagttgacatttagattgttttcagcattggtctactatgaataatgcatccatgaacatacagttacaagtctctgtgtggacatgcatctttatatctctttatatcctgagaataaaaaggctggtttgtataccaaatatatttttaatgttttaggaaactgccaaattattttccaacatggctgtattattttacatttacattagcaacttataagagatccagttactctatggtctcagcaacatttggcattgactctatttcattatagccattcagtgagtgtgtagtagtatcttgttgtgattttagtttgcatttttcctgctgactaatgttgaacaacttttcatgtgtattgtcattcatgtgatttttggcaaagtatctttgaaatattttgcccgtgttttagttgttagtcctcttactgagttaaagaattccttattaatttgggataaaacttgcaaatagtcctctcattctgtggatttgtttttcattttttttattggtatactttaaaaagcaaaagcttttacttttcatgaagtcaatttaccaagcttttcctttatgggtcatgtttttgtgtcctatctaagaaattttggattgactcaatgtgaaaaaaaaaaattctccatttttatcttacagttttatacttaaacatttacatttagatccatgaaataatttgaattagttttgtacatggtatgagttaagcatctaagttctttatttcatttttattttttgacacataggtatccaaatgttccattaacatttgttgaaattgccatcctttccccattgaattacccaagcatctatgcaaaaatgcagttgaccccatagctaacatcatattcaataatgaaagactgagatctaagatcagacataatacagaaatgcccacatattagccagagcaggtaatcaagaaaaagtaagtaaaagtctcccaaattagaaagttgattttctttacttgtagatgatatgattctatatgtggaaaatccaaacaaattcacaagaaagctactagagctagtaaacaaattcagcaatgttctatgttacaagatcaacacacaaaattagttgtgtttctataagccagcaatgaataatttgaaaaagaaattaataaagcaatttcacttataatgcatcaaaaatttaaccaaggagatgaagacttgtacattatctgttttctgtgtttccaggaaacctatagtataattgcgcaatgttatttctatgcactgttccttttatgcttagccatgtgctctccagtgtctcatgagtttcatgcaggatctgtgtgtgatcacttttctattaggatgctaagatagaagtaattttcccattagtatatattatctgtggtaataaatatattacttattgccaaataagccatttataattcttgggatgtaagaatcaaggatgccttccagcacactggagggtagaggaaataaaggtgatatttattgaacaattactttatacacatatacacacacacacacccctacatacatatgtgcatgcacacacacacacacacacacaaacacacacacaccttatcttcaaaataaccctgacggggagacattatcattctcttaatataaatgagaaaaggttcagagagtccaatcaatatttgactataatcatacaactaccaaagttccaaagctggagattcaagctggtggttcccaaagagatggatctagtcacaatattatactctcatcccataaaagagagtctggcatatgcaaagaccattcttggcaattttgatgagtgaatatgtgaacattttttaggaattctacttcaagcacataaaggttcaagttctctcatgctcaagatttaataatattattctcaaaagtgttggtaagtcatctaaaccttctggcttatgaaaatttcaacttaaataccaaagaggtactatttatttatgctgtggagtcagacaagattgtggttgacatggtcatagcaagtaatcagcttaaatgtttggaaagagcctctgtgtgtgaagaacttttgttgccaaggatattttcatgtaatgcaaatcattttctacaccctttgacatgggagtgaaacatctatctctctttcattttcattcatccccaaagcattttgctgccttagaaaatcatctgaaggtcagttttgattgctctaactctgaaatctgttgtgttcctgatagcatgcagagttttagatgaaatcactaatattcactaaaaaatgttaaattaccatgaattgcaaggttctttgagagtgctgtaaatgaggcagttgatgatatttgtggctccaccaagaacaacaggatttaaaaccctaaattaaaatccactgaaagggtcaaatgcattttcagtgttcaaccgatcaaagtgaccatatcaaatatggaaaattcatgaattcaaaaatgtaaggtgttattcggaaataattcttttctcatgtgtcattatgagattgttgctactcttttcctatgtctaaataggcatatagactgttggaatgttaatagaacaatgcaaattccaaagaagaaaaagacaaaaggagggcaatgagcatgtatctagtttgaatattttaaaacatatgatgtaaatattatctgccttaggatcagactttgtctttaggaagcctattcatagtacatggaattttatatattttacattcagtgctgtgcagaataaaacaacattttccccctctgttctcacaccaccatcaacatagttgaacaagcaattctgcagcattaatatcctacaatccagttcaactcttgcgctatatacctggaagtagtggcagattccacgggtgaggggtcagtccccaaggctgcccccaacttctaacaccaatcacaagctccaggttattttgcctgtgcttgtaacccactggctataaattggggctcctatgactccctccttgggttcaattactttggcagctcagctcaaaataaggaagcacttatttttactgatttatgatacaggatattgcaaagatacagatgaagcaatgcataggacaagatacgtggaaaggggagctgagcttccatgtcctccctaggtgtcacaccctccaggaacttccacgtgttaaactacatggagctctccctgtacccccaccaccccccaccaccccaaacaccctttttgttgttgttgttttagacagagtctcgctctgtcgccaggctggaatgcagtggcgatcttggctcactgcaacttccgactcccgggttcaaacgattcttccgcctgagcctgccgagtagctgggattacaggtgtgtgccaccatgcccagctaatttttgtatttttagtagagacggggtttcaccatgttggccaggatggtcttgatctcctgacctcgtgatccgcccgcctcgaccctttatagcaacttcattggataggcatgactgaagcatggatgtggcagactaccacaattactacttgagaccatcactacaacagttactactgttactatttgagactgtcattacaagactgaatgaaggaggatgaacgcagaaatgaaaacttaaaacaaaaataactattttacaggaagggtaacatggggaagaagaagaggggtccctgcttcttgtgagcaagggcagctgcctgagctgcttcagcccttcatatttattgggtagaaagagcagggaggaggagggcatgattggtcagctgcttgattgatcacagggtcatattattactaacaggcttcagatttgcctaataacaagaaacacttgtgcctgggtcatgactgccctcagcattccttccgggtgcagacgcagtttgtcagcttgccaacatcctgctttcatgagaacagtttgctgtttactcatatagcctccagtggtatacttagttgatcacgaccctcattcttttggccttcaacacatggacaactatgtagaaatgtgatttaaaaaaaaaaaggagtatgatttcatactaatcgactgagtggggaaaccctgcaaggctgcctattcagagtcttcttggcctctctctgcagtattcattcctccagggcatggggcaggactccttctaaaatgagggtctcatgacccacagtcagacaaggtaggtcagagaatttccttatggccggctctaagacagaaaggtggaggaacattagagtatatttttagtttccctggcctgccttggggagaaaaaggaacaggtagaagcagaacagaacagagacagaccctattttctgaggcctacttctgaagcctaaatctccccaatattgtaacaaaagactgtccttcacctgtatcactcttaaattgttctgaagctgcttcaggacccttggataaaagaccaatacttcaacaaaagataggcttattgtgttagtcaccaaggaaatagcaaaggctatggaagttatgagccaggaaccatggacaaaaacgtgtgtgtgtgtgtatggtgtataaatatcaaagtgctcttgaaatcctgtcttaaaatgtaataatttgattatattatatcttttagacagagttcatatattatatctattaaaaagagttcatcactcatgggtcctggtgaattagcaatagctctggggtggaagtctttgcttagtttgcagaataacttcactttactgttccctacttttccactttgctctgtcctccaagattctatgtggtttgcatcagcagcctccattgccctctggccatcagttagttgatttcagctgctaagagggacccaccaaacatctggagggcaggtggaaaaggaagtcaggatatttaattccccgctccctgtgtccatgtagaagcagcctcaagctaactgcatccctccatgagtggtcatagctcctgtcaggtgatgctcttcatacagtcatttctgtccctgagttctgtccccatttaagctagagatagtgtgcagagaagagttaacatagcaagcctgactgcttatttttagaaagacctgcttacaaagttggcctttggctgacatctggatccccactatccccagaactgataagagaggaccactgcacttaaacatttgtacaaagtacggtttatgcttaacacctgctttccttgtgggggtcttaaatttgggtaaatgccagatagaggctgctcataggaacagcccccaataaaaaccctgtgcactgagtttctaaggagcttccctgattggcaacacatcacacatattttcataatgcattgctgggggaattaggcccattctatctctactggaagagaattcttggaagcttgtgcttggtttcccctggacttcattgatatgccttttccctttgttgatgaattctgtaacatttcactgtaataaattttagccatgagtaggactatatgatgagtcctgagtcttcctagtgaatcattagacccagggttcagggttggcttgagaaaccctgacataaatagcaaaagagctctgcagttctgtacctgagagtactggaccatctcttttgcccacccttttgaaagtggttcctttattgagctctccccaagttactttttttgagtgtgctttcttttactgaggcttctagtgactgtagatatttcatataaaaatattaattatttgatggattcttttctgtaccttacatttacatatttcttaacaaaaagatgaatggtttaaaagtaaggtaacacagcaacctgtacccttgacatcttatttaaggagaatgtttgattaggttgtgcttctttaaatggatgggggattgtgcatcttgtttaaactagaaaatagtacgtaaactggtggttgattgtccctaaaaatatttagctgttgtttttctcctttatctttgcgtattctggtgaaaaaaaagaaaattcactctcaaaagcagggagactaagaaaaatttacagtgacagaacacaatgttttcatggtatatatttatattatagaaaacatcacttaagtagtgagatgaatgttcttatttcttatgtgcctgataagcaattgtattacatcttaaaaacacctctaacaggtgatggtacattcatatagtatattcaaatcgtttcttgataatatttagattatttaacatccatagctatttatatcaccaaatattattctttcttttacactgtgctctctgaagcaagataaagcattgtgcttaatggaatggaaagcttcctctcaaaaacccaaagattatgctacttaaatttcaagtttcaatggaacttatgtcaacttttaaattaactatgtaaaaaataaatgttgtgcatccttggatggtttctcaaaaaaaaaaaaaaaaaaggcaaagaaagaaatgcttaatgtaaactatggtggttttttacccccaactatatttatgccagctgctttgacctaaaaagtttttttatgcttatagataaaaagctttgttttagagaactcatgaaccctttgtttattaatgtcttggtaaaccacatgtcttcttgataaagcaatcctgaatcagaaagacctctttgctggatatcttacttcagtttgcttttctgtttattgattgctttgctaataaatgctctcttcattgtaatttagctccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtgagtttaagggtttggtaatagaaataaatattctgagaattgacacattagttaagttctttgacattgaggataaatgctgttgtggtttcctctgtctggcacagagtgtttcaaacagagataaaattacaaatttcactagtaatcaaagaaatacaataaaaatgagatgcttattatctgataaatactaatgcttatcacattctcaaagatgaaaaaaaaatgaccccatcaagaattgatgggaatgtggggaagctggaacttttataaactgctgaggtgtctgtgtgagttcattagtacaacttttcatgtacaataatttgttaaaatctatgaaaaaatctttccttttaacataacatttgacttagcaaacttattttaggaagtttatctcaagtgaacagtcattaagtagacacacaagatgtccatacctattctatttgtaacatcaaaatattgaaaatgattcagatgttcaacaatgtttcaggaaattatagtatatggcataacagaatcctggtacattgttaaataaattataggctatgatagcatataaactgataccttagttcacatatcaataaatggaaaatgttcatgacatattgtttaaggcaggggtccccaatccccaggctgtggacaggtactggtctgtgacctgttaggaacaggaccacacagcaggaggtgagcagcaggccggcgacattactgcctgagccctgcctcctgtcagttctgtggcggcatgagattctcataggaacaggaatcctattgcgaactgtgcatgcgagggatctaggttgcacgctccttatgataatctaataataaatataatgcgcttgaatcatgccaaaaccatccctcctcaccttcccatcctgggtccatggaaaaactgttttccatgaaaccagtccctggggccaaaaaagttggggaccactggtttaaagtaaataaagttattaaaataatctgagaattataccattttaatttacaaatactggaagacataataaatagatctagttttctctaattgtaaatattatagaaaatgtatcaaatatttctattataatgaattcaagttttttaattctcaggttaaagaactattaaatctggcagtggagtactaacactcaagcaaatagtgtaatttaatacacacattgctgtttccgcagagatagaacacagcaacataaacttttgaaagagaaaggatataaacaagccatcaagcctatctttgcctttgtaacttttatgaagattttaaaggagcttatagaaatcaaattattagaattcattgactttaaaaaacatttactcagatgttttagatacagtttccctaaagacagaatgaaaaaaataggaatttttacattattccagctctatcttctctgatttttgcttctagccatgtttagctacacactagtttaagaaacctcggaacagcaattccaattcaagtttctattttgttctcttcatttaatacacagttttccaaattctactttaaccatgcttaattagttggagaactgtttaaagctctgtcgaaacactgaaattccataaccttccttaaaatggttaggaggatgccttgttttaacattttaattgactttaaaactcctgcatcgcatagagttttattttgtatgcattatactgggtttcattttgcacctaattcatataactggaatttagtttcttatgtccacccctttctcttggctctacatgtctcttcagtattccaagtcttctttaaagttaatggaaactctgaacttcatgatgcagattgcaaagggaaatgaacatctgtctacatctgccatgttggcaaagtatcctgaaaacctgctactagaatgtttattttcttccaaatatcagcatgatccaggtgtcctgaaacttaaacttttgtgacagagaaagagaggagttataaaaatattgaaaatgattttgaagatgacagtaccactgattatttctgaagttgtgaattagggtcaccctactttccatacagcttaatgcaatagcaaaattaaacttaaaactatcaatgatattattcaagccagaggcatgatttccatagtaacatattgtgatctattttatagaacatcacatgttagtacaacattggctgtttttgacgattgcactaataaggaatccaaataacattttcttacataataaatgtgtattcattcactaatcagacatttatataatcctattaaacaaggtatcatttcctaaaaccatatttttcattaaaaaatgccacttctggcatttcttgacaatcactgtaattaatgatgtgaaaattatctgcatgatggcatttgaacagtaagaacaattggttaacactgtcagaactttgtatcattctaacaatagcctcatgtttattactctatttctagtgcgtggctagcatgtgtaacatgtaaaggaaacactacttatattcagctggatgaacacaaatctttgggttaaataaaggcattaggaattataggtggagaatcattgaacttttcaaagaaaattaatagtgttgtcttccaagcaagtttgatagtttgtttgagacctttatagaattcttttttagaatggaaactttttctagctggcctaatgtactatgggattctctaagacatattttccttcttaggatcatgatatactggtgtaccatctttaaagctttcaaattatttgttattataatagcatgcaaataatgaataattttaaagattgtgaataattaactttaaaaaacaaggtatatctttacgttttatttaaggtagaggtcaagctagcgcttcgagaatcatacataatcagccctaacagtatctctattgtagcccccttctgggttgctcataggtatcttacgtgtcataggaaggaagtgaacagttattggaggaaatagcactcttctgttagtgttgcaggtttagggagtggacagtaactcatactgttttttggtgttgttcctatttgagtttggaatcaaaggagcactagacatagtaggcagatcaaatttaaaaataaaaacgatcttcattactgatgaaagtcagattagagactatatcctttttcctgcaggaagacaaattagaagagagaaaaatcaatgggctgatctgcacataatttgctccctacaccctgactccccagattcacagtcagatgagttgttcctcatttgggatggcatgaatggggagatagcccttaaatgtcactttagagaaatccttccacaggaactagaggatgattatttttacatgtaacaatgacttctatcacctacagatattatcgtagtttaagcttagaattttagacaaccaaatattttaatgagccctgggatttcatttctacccttattcatttccatctttaaaattataatttataatctcatactacatcaagggatcaatgtaacaagtggtaagatgattcagttagctctgagaggaataaatgaagaaatataagatatagagacaggatgagaaaacagaagagaagatgacaggcaactgtttttataaggctcttaatattcttaatgcggtagtttccccttatccatggttttgttttctgcagtttgttactcatggtcaacaatgttccaaaaataggtgagtctacagtacaataagatgttttgagagagagagaaagaccatattcacataactattattggggtatattgttataattgttctattttattttcagttattgttgttaatctcttactctgcctaacataaattaaactttatcatagatatgtatgtataggaaaaagaacagtatatatacacacatatatatgtatgtatatatatgtgtatatgtgtatatatatacatatatgtatgtgtgtgtatatatatatagtttaatactatttgttgttttaggaatccactggagatcttggaatgtatctcctgtggataagaggggactactatattctttcctggaacaatagatcaaatatgtatagaaaaatcattcatgtgtttaataaaattttgttcagtgcttattccagaccagaaactgtatcagtcattagaaatacaaagatgaaaggaatagttctccttactgagtggggagacatataagtaaaccaaagtaacaatagaatatataaatgttgaagcagagtaaacttggggtgttaaggaagcacacggtggcttgggaggtgtaggaaatgtaaccatgcctgtggtggcaatgatgtgatggagaaccactgaaagtttcccagtaaagaaagaatataagctgaattagccagatactgtagttgaggaagcgtgatggtcatgaaataaattttgtattaaaagaaaataaggtatattcagcaatcatgggcagttccatgtagctttggtaagtggtacaatgggggagtgctacaaaccaggagggtatcagccaagatcacaaatcagtgctgagccaaggactgtaaatgtttctctgaaaatgcagaagtctgtagtaacagcaaattttcaaattcagtgttaaagatccgtaccccaaccaaggagagcaactaccttgagataagcactcttttaacctgagtattatttttttgttatggatcattaatggatatcctattcataccctttcaaatgcttttatatctttcacactataaattgccttatatgatattcctacacaaatgcatatttccatcccaattctatctgattctaatttcttattaagtagactgctcttgtataatacattctgatctattaggattatattccacttttcagatgctacaaacattcagcaagtactgtacttcttttaattgtcatcaggttataagtcttccaacttccagtttaagcttatgccagacaatcttttggaatattcagcactgaaatttatttttttcttttaggttttggcttttggcatgctaaattattttccatcgttgttctagccttcagtgatttttcaaattttgttaatgttttcaacaaccttattgtgggataagggtaactttaatctaatctagtaaatatttattgaaataacaatgagccacagctgcacgctctctagaaagtctgaatctcagccctaggggacttttccaaatatgatccttctttgggtgctctgccttagcactaaggatggtgactttcccctgtctcttctattcctatattctttagagttttctgtaccacttagaaagtaaaaccaggcgacctctggtacccatggtacaactgaaaacagccaccagagagagaactgtctcaccttcctcggctctatcagggtcatctctgataagacagtggccctcacctgagtcagtgcccaaggtgccccccacaacaccagcggaggcctcctccactgagcagtcggaccccagagtgctctgtaggagctgtagactgggaagaagggccgggtgtggtggctcatggctgtcatcccaacactttgggaagctgaggtgggcggattgcttgagcccaggggttcaagaccaacctaggcaaaatggtgcaaccctatctctacaaaaaatacaaaaattagccgggcgtggtggtgggcacctgtagtcccagctattctatttgggagactgaggcaggagaatcgcttgaacccgggaggcagaagttgcagtgagccgagattgtgccactgcactccagcctgggtgacaaagtcagaccctgtcttcaaaaaaaaaaaaaaaagaaaaaagactgggaatgcctaggtttacacgatgggttatcactccaaagatttgtgtcttttgtggccaatggcagatccaggaaagaaatgaaagttgccgatggggataggctgggggagagcaatacagatgtgtatgggaaaccccaacccatatatattgtaaatagatggactaggctaaacattgttgctgtttcagtcttctgcaaactcagcttttccacaataaagctctatctcctgtcggaaggaaggaaggaaggaaggaaggaaggaaggaaggaaggaagggagggagggagggagggagggagggagggagggatggatggggggaggggaaggggaaggggaagcacataaatatgctgggaccttcatattgctatagggcacccctgcttaatggaaccctcctcgcatctccaatgcaaacagccccatggcggagcaggcagcagccactctggtatttgtgtgtttcgcagtcctacagtgtgtttcctgtccttagagaacaaggatttccagccatgtgcctaatcacctccactccctatcttattttttaaaaacctctttgtagctgcttctctttgccctcacaatccttcatgcatagaagtcctgcttatctaaaacttctgttgtgtaaattcctcattgctgataacaaatgtctccaaaatttagcagcttaaaacaataaacatttataatttctgtaggtcagaaaataagaaaattttccattcaagatgttggccaggtgacagatttaccccttggtggtagtttactgacccttagtctggtgtgtttagtgtttaacaagcaaacaagttacatagaggaaacatagttacttttctgttttggagaaccgcaaggactttctcttagaccttctaacaaaaggacactatgaaaagcaaaagaagaactaaaacaaacatctaaacattctttattatgaatgatactttcttatactcaataataaaagcaatcaaccggtatttacattatttcaattttaaaaatatgaaatgtatccttaatcaaaagagtagattggtatagtttatgtaattaaataatatgataggaaagcagttagcaatgattcttcaccaacttgtgaaatgtaactttgttttttttttttcttttcatttcaggtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggtaagaatccaaggctgagattcccctttttggtcaagacatgaatgagaatctattgtaattgtgcaattaggaatttggcagttgtattcctttttataactgcacaatataataattgagaaacagtttctaaagatataagatagtatttgtcctggttagtggaacaagtgtatttcttctaatctaataacaaattccattcaattaaattgccccttaaaaggctaatattatctttgctcttaatgacatctgccataacacaaatgatgtttataatttgaaactcacttatgaaatgcattatatttgactgtgtcacaagttagggcacccacaagcagtacatttttctcttctaagcaagaaaaagatataaaatgatacaaaaaatatgtatataagctaactgactccattaagttaatttttgcattcatgcatttgaacccttggttatataggccagacacacattcacagatttttaatcatttatatcatgtacatattatagcaaaatctttctttagatttgtaaagttatttggtaaaactgggtagagattgactataacatttatgcaaacagggcttatgttaaacaagttaaattaaaacctccaaatttgaaaggatacagactggagctataatgatcaaattccccaaaagaactggccattcttaacagaaattgtgaatatcaattctgaaaaagattgaatttacctatgataaagtgtagttattttttgtctatgtgttatccattttggtttgttttcctcatgagtatgcctttaatagtattttatacattcatctatatagcagtttgttgtcttctatgtacctgtcatctagattactaaactactaaatcactacattttgaatgctaaagaaattgacagtaatctaattagaaagacaatgaatatccagcactctttaactgacctgtccctaccctacccctaaagtaacccctttgtctgatgagttacgtaggttcactatttaatttctctaggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcaggtaaagatcaatgttttaaattctacttttaaaacctctgaatgcaaatgtttcctcaaattaaagtcaaagtactgtgaaagtacattttgaaaagcaagaattagaaacttccatagaccaaggaaaattttcatatatatggatttgttacataaacaactcaaggtcataaagtacttgcagcaagttctagggggcaaaagtaaatgctttagttattaattcatggggcgaaaatggcttaactatagttatagtcttctgggaatgtttgtcaaaaatagcatttggtttccactcctgaagtggattggacacatgtctcatcttgctccatatacagcctaatttatgttcaatgaaagagataactgtcaccaattccacaaatttgtctttgtttttatttatctttccaaaataaatagtttagatactagattgtacataatgacagaatcgtggacatcaaaatctataattcacaagtgtgcttgtaagcagttggcatgatgataaggaaggaggacaacatatctaaattttctggattatcttcattaaggcaaaaatttttaatcctccactttattttttatattaaaacacttcaaatttcatgagcctttaagaaaaaaaatacacttttgttatgtgtttaatctgtagatatcaaagaaacccaaaccctgatctaaacttgacctgttaggaatatggaggatgagggtagctttaggttgatgtccaagggaatcatttcatgaataaaatacgcattgtgcttgagcatctcttaatgactaccagccatcttggacaaataatagagccatgatagcacaagtgatgaggcatggcattctggaaggggaaaatcaaggtcagaaatgaaaagtaatgggtgaaactgcaatactggtccctcgtaatcttatgggtcactagctaatgaaagtgcaatgagttcctttgataatacacctttggttagcacatttaaaatccctgtaaagagctcaggagtggcaggggggaaagggaaatgcatgtgtatgtaacctgaacatttcaagaaaaatttaacaaaaactttgagacattcattggggttatttagaatgctttaggtttacctctttctgaagaataatattcagccagctgcattggattggctcaatgacatatttccctacatgggaaatccagtacatcaccatgcatttttctgaactttttgaactgagatgttctatttttgtgacgttttttagatactcgtaagacttataatttcctatctatccactttcctatctttatgaacatgagcaaattcctatgagatttttattttgcaagtagaaagtagctggtaatatgaagatggagaatatactttcagataacattttaaaaagtgaataccttttacatataccagcatattcttggactttttcaaagcagaatattttaaaaggtaaaggtatttcagaaactaaatgaatgtgtgaattaaatttaaaaatatatagggacgacattcattgttttgatgttattgttattgttctcattgatagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacaggtattgttatttttaactaatgtcctttcagaattggcttagggcttcatttggacattttttgagtttgcagaattctgtgacagaattctccctctatattgattaaacagggcattttttcttaatataatattatgtgtacaagcctccctctttgtatgtcacttgtatttttccagtataatcatatattgaaactaagttggtataatttatttcataagacttgttttttttccatttatcatgtatccttaaatattttacatgaagttgactttcattaactgtgtactatcatgttatttggacacacaataattatttaaccagtccacactcagttgatattgtattgtattaattcttttggaaatataaataacattgataaaacttcttatatgtacatttcatatacatttctacttcaaaaatctgaagaattgaatttatcacagcttataacaaaatgaattatgaatatgttcaaagttttgaatatacagtcatatattgccttctagtaattcatcccccagctagcagtagtgagaataattatcatagctaaaagttactgaggctttactgtgtacgtgaactaattcatctgatacatacagcaatcctagaggataggaggctcttgttctctccagtttacagttgtggctgatatacctctctgcccattttaccagcatccaggtggccaatagcagaagctgatggaaggatgtcaaccgaacaagttcttctgtgtatttggctgttcagtgcctcctctgagagagatgctcttctctgggcattagcataagataaaaagatctttacactttatacctactcccatagatctagccacatttttctttccatgaattcctagttcctgatccttccatctttttttttcatgcccttggccaatatttccaagccactgccatattgtccaggtacattttaccttgagacacgtctctttccacacaacatgggtgaccaggtgaactgcctgaagttctgcccactaagaggatttcttcgctctgctgtttcacagggtcatctctgacaagggttttagagcaacagctaccatttagacttgcagccacataccaagacatcctatctgtaaactaaattctgctttttttccacattctttcagctcttaagggacctcccatgggtcataggtatgagctgaggttgagccaccagtataagaatggtggatgtcatgggggcctgaaccacctgcttgcacaatgtattacggcttttggctctgcttatacccaatctcagacatccacttccattttatgatgaatttctgttgggcccttctaacctcaagacttggctgagacaattccaagattataaaaaagtagctctagctgcatggctatttggtgttccatgaccagatgttctgtttttactgaagcctgaaagcatgctagggccatttagcaaatggtatatagtttccattacatgttatgcctttgttccaagctcttggggtctatctgccctgtgattctctttctatgtgtgccttgcaacattttttcccacaatgcttacctctagtgctgtaaaaattactacatgttatgtcccaagtggctcatctgcctgtaccacaggctggacctggtgcagagccctttccgcctctgggatacactcaaaactggcagcattccatattactcagtaaatttctcagaacagtattctcaaatgtggaatatgctcccttcagaatgtgaagaggtcaactagacattttgtttccttcttagtggtggtagaagcaaggtgcaataatttgtcctttattttggaggggatatcctagcatgtctcaggccacttgaactcctaaaaacttcactgatatggtagattccttaatcttcataatattgctgtctcactttctagaacacatatgtcttacctctgcatacctaccatttcttgtttgtctgattcatttaatatgatgctatcgatataaagaatactgtcaaggtggcatttatagtttgtcttaaattggtgattaatcaccctcagatttcctttgtctttcttcagtgcattgatggcgaccagcaagatccatgcattgtccttataattactagtttccccagagtagtccttgtaattactaattccaccaaaccagtgaattaccttctactggtaactcatcgcagttcaccactaatggaagtttaagcattgcaccactagggcatgctgtggactgttagtactctacctgctgtctatgatgagatcattgtaaaccagcaagtggatgatggagctccaaaatatcattttagagtctccttcctagggccagtcctgttacgactatcttagggcaaattcccccggaagcagactcttggtagaggactgagtacaggaggtttattgggggaactctttcagaaacaacaaatgtgaagtgataaagtatgtaggattgagcagcaaagaagctgaactgtgatgcaatagtggaagcagcctcagcggattccgtgggtagttctggagctgaaatgaccctcttagcttatctcaaattaagctaggaagtcagacctttgtaccctagagtatttgtgtcctcgggctggtgtaacaaattaacataaactgagtgtcttaaaacaacggaaatttaggtgttagtacagccaggtcccccacaggctctaggagacaattcttctcttctacctacctgtggctcctggtgttccttggcttgtggcaacataactctaatatctgctgcctctgtcttcacaagtcctactctgtgtctctgtctcctctgggtctgtgtgtccgtctcatttctcccataaaaataccagtcattggattttaagctaacctgaaatccaggatgacaactaattaattacatctgcaaagaccttatttccaaacaaggtcttattctgaatttttgggagacactatacaatccactactaataggtttgccatttttttctaagcctttttaggagaccagaacccatgtacaacacacaattttattttctatactgatgaaaaagaagagccaataaataatttatgattacttatttttcattaatctgtctacgtgttcactcatttgcaattatctcatgatgaatacacaactggcataatatatatattttgacttaaacaggttagtctaccgatctggtataccatgggatttaaggtaaagttagttgtaactttcatgtggtctttgccatgttgtatctcatttatactcaatgttttattttgttgtttttactattctctggctttataaactattctttctttgtaaaacacagttttgatttatctattacttatattatagtagttgttgttctaagaaaaaaataaggtgagaaatattatttataaaatacagccttagaagtcaacctgtttgttcatattccacatctcccaattattagctgtatcacacgtctctctgcttctggttttattcatctgtgaaatgggaaaaccatttttgctcacctacctgcttaaagagcctgataaatattgacacattattattagtgattattattaatggtgtggaactacattatactttataaactagctatcatttaatggggcaggaaaataaatatttttattattgttgttgttatttaaaaggctgttccttatggctgaactggaataaggacatagatatatcaccttattctcttttttatttttatttctttgagacagagtctcgctctgtcacccaggcttgagtgcagtggcgcaatctcagttcactgcaatcttctcttcctgggttcaagcaattcttgtgcttcagccttccaagtagctgggactacaggtgtgtgccactacacctgactaattttttttttaatttttatttttagtagagacagggttttgccatctttgccaggttggtcttgaacccctagcctcaagtgatccacccgcctcggtctcccaaaatactgggattacaggcatgagccactgcactgggcctaccttattctcttttgaactctctctcctgtgcaaatattctctgttcaaggaaatgaaatcaaaagtagcagaacaaagtccaattttttaccttctcaatgattaaatttgtatctgaactgacctgagtatgtcttgttataatctttgtaaataaatagccaaaattcccagggaaaatctactataaaaataactagtaagaaacctttgcctaagaatgagacaggggggatacgtaaaagtggtgatgatgtaggattcattgtgggggatcaagctgctgtagaatttttcctacccctttgaagacttatttcatgaaaaactttcaattagatagattttataagacttataaattgactctatgtacatgataaagacaaagtctatccaagtgataattttatgctgcaagttctggggccaataatgtatttttaaaataatgtaatttataataatcatctgtaaagaaggaaaagccttttcaaaataaatattagtgtagatttcttctttcttattttatttcatcgtgggttcttgctacaaagaatattttgcttaaaaaatagttgtacttcctaaattaaataagaaatagcttcatgtactttatcctaaaaacaataccattttctaaaaatttacattgaaatctaccaggattattctaaaagggatgaatattacagcaatattcataagtttaactcagttcaaggtttattttacttagaaaattttaaatcacatttcacagaaaagtttgtatcttcattatatcaataatgattttaaaattagaaaaataaagaattacttggtatttgatgtttttcttatttcaaaatgtaattgcaaggaaatggttttaaagttttaaatttaaattattcctagagttttagaatctttaaaaacacctttatttctgaatgttattgaaacactgtattctacattccaatctcactgctttttagaacaactcatgtaacttacgaaattttaaagtcaacacctaggcaaatattccaaatgaattttattttacccctaaagagaaagtctctagaaaactactccaaatgttactgaactttacatttatctgtatttatatttatggaagattattttatatgactatgtatcagtagccctaagaaaattagttttgtactcatagttactgtcatactctctgttttaatgacttttattttctgaatataatttctagtggcctttgtacctacaacctaaacaaatttacatggttgcttttgatcacttcaaattataatgacagaaccaactctcaatgttaattgtttaataatttatttatggactgtgagtttcctgtcagtcttctttgctcaaatctgctattttcatttgaaattatatgataaagataatatttcaaataacgtaactgtttgatctaatctttatatgtttgtttatataagaaagatgattgagaattgacttaacgtggatgctcagtaatatgcttaatgtttaattttttcccctttttcttctgtgactttttttcataaagaaaatgatagtatcgatttaacatagcaacggcatttctttctgtcctagcaccatcaaatagcttgggtattactgctctgggttacttttggccaagccccatggctttgtttggactttatcatgataacaatgacaatgtcaccgtctttatctctaccattggtgacaataaccataccaccatgctgctttatgaggcaataacttggttttctcatttatccactcaggaactggattattacctcataaaacagtgtgattgtacaataatcaattaaatcctggcttgtcgagactcttcagaaaaaaaaaaaaaaacccttttcctaatggtggttggcaataattccctctgtctgaattcatggaactttgactgccaaggttatattttcacactgattacctattatctttctttctttctttctttcttttttgccttgaagctgttgcacactgctaaatcccaagaactatcttacactgtagaaggactgaaaccttataggatatatgagtttactattactctctgcaattcagttggttgtgtgaccagtgcttcgggagcaggacaaactttagcagcaggtaagcaagttttaatggatatgaaaaatctgttgcctatcaagaaaaaaaacttataatattcaacaccttctctacttgagactttatatttgtcttctcctccctcactaactctgattgcttcttacctcaacagttttaaacaacaacaaccaaaacgtaacttaaagaggtacctaggagctacgagttacagctgtgtcataataagaaatataattagtggtagagtgactccactctacaactagaaatatatagaatatacaactagaaacatatacaaatatatagaactagaaatacatagaaatgtaattagttgtagcgtgactccagggcttaactaccaacctgtgtcctagcagtgtcctgacaattgtgagaaacaatcaggaagcttcttatgaggacgttaggatacctcttccctcagtccagacattttttgtaggcttggctctactcactcctgatccatgggaacatctagaaattactgtgtggcctggtgttatatttggctttcatgaaataggtaaatgtttatctattgttttattaagaagaagcttttaagttaataaaatttaaataaaagaattgttattaagtataatctgagtagaaatggtttgtataatttgtgcttgcttcattcaggactaactggattcatacaaacctgattacatgtattagtaagacttataaaacccaattatttagcattaatatattttcaaatcagtgtttttctgattctagataaaagcttagtttcctggttatctttaaagaaatgtccatgtgtaaggaggttaagacactctagatgaattacagatattacgaaaattcatgtttacctgtaaaaacatttcctagacctcctccccaaatcccttcatcctattattaataggtccaattatgtagggttttttttctggttctggaaaaaattgcttagctcaaatgatctcatccaagtaatttatttttttcaaaattttcattaatgcaaacaactctgaaattctaagaaattatggtttactaaatttataactgaacactttgtatttttatgtattttatagatgtgcatttcagatgcatgaatacattgatggagtacctagcttgtacaaaacactcttctcctataaaactatctgtttttgtatactgtattattaaaggtttactgaatgctgaatatggacagcagaggaggactctatctcctttaaatgatacaatttcagactagaagacaaaaattaaaataagaatcagtcttacaagttggagaaagtaaaaatggagacaacggagggtgaagactgggtgtgttatagtaggggacatagggatcccaagcacgtggccatgcaaaactggaatcacatcctctcagggttgcaaaacatgtaaaaataatctagtgttactatatagccagtatcaatatattctttgtaatattcccccaagtgttcatctaacccatgtctgataccttcagtgttacagaaactactacgtctcagacaaagctataccatctttagatacctcttttagaatgtgatttcttagattggtcaaaaatatctcctagtaacttctactcaacattcttattctacttccttgggggctgtcgttaacctaatttatcatccttccaataacattttcaataacattatatccacccaagtcttttctcctttaggctgcatatcatggtggttcccatctgaacctcatatgcaatagtgtctagagctgttattagtataattcttgtagatgagatctagtctgccttttcatagatataagcaaactaaagaacctgaagagagacatgcccgtccctagaaactagctggatcatggagatgggaatagaagagcaggaaacatgtctacagaatagaatctgcctgccctatgcattagtggtaacatctgtgctaatagtatcctcattggttgcagtggcaaaatcctgttgcgtaaaagatgatgtacctgggtgctctgtgcagctctcattttagttactggtgaggcgattaaaacgactcctgtccactggcaggattgtgaagtaaaactaactagtcagagccctctgaatcctctctctattttttttatccttgaaaaatagaactggaaacttatattcgctaaaagtcatgtgacgtgaaagttagttgacttacaaaaataagagtttattcatatatgtgaggggaaaaaaatggttagccaaaatgccagggtttcaatccgggctctgccattgactagctgtgtgaccttatataaattatctaacctctgtgccttagttttccaatttataaataagcataacttatttgtagggttctgatgaggattagaattagttaatacatgtaaaatatttaaagcagtgcccatcacagttcattctcaataaaaatttattgtcatgatttttatcataatattatagaagacttttgttagtcacagtataaatgttatggaatttctaatgttatcaaaatcaaggagagtttattttacaactttgattttctaacattattataaaatataaaatggagagttctaaaactaaggattgtattgtgaaaataaaacttagaaaggcttaaaatctgaaagcattatttattatttctgtaagaagtatgtcattcagaattattatgcacatttcaaaactttgctcaaaaacagcaaatttcacatttgttggttgcaatatagagttaataatgtgccataaatgtattattactacattttattgtgaatgctcaattcagaaccatctcttgagggcttactatttaaagcactgtggaggattctaagataattatactcagcatttgggttaaggagttgagatccaacaggtaggattaacaccatggcgacatgtgctaagggctgtgagaaaggtgaaaaaaatgctatgggaaggtagaaaatgagataaatgattttgatttgggagactgagtagatacctcattaaatgctatttcagataaactataaaagaatggtaaagactttcgcagatatttactgagcacatacaatgtgctagtttctgttttaggggctggcactgttccaagtactgatgtaatgaaagcagagatttatgaagacttccctggtggtagagtacacaatagattagaagagggagtgtaataagtgtctggtagacttttttaaaaaggcaataagagagtaaatcagacgagtagaagtgaagattgaaagaagggaatggagtgacttcaaggaagacagacctggaagttaagcagtgggaaggatggacaatgatagcaaatattgcagcccatggtggtgccattaaataaaaggggaaagatgaacaaagaacagatgggagaaataaactcgtgagtttatttgatcatttgatagaaacacatccatgccaattataaccatccaggagcagaaattgcaaatctggggcttaaaaatgatgcagattttgtattcatctgcatatagatgggagctaatgctataggttataatcaattagtgaaagcagagaaaatgcaaaatggaagcccaaagaaaacaccttagtgaatattctatctgggaagaaagaagaaaggaagagtgaagtgaacagaggtatggtcagaattaggaaaagaactgagaggaagcagtatcagaaaagtcaagggaagagagaattctagaaggagaatattgtctgcagtgtcatatggtatagggaaagcaagagaaatgtgacctaaaatggatgcgaggtcactggtgactctctggggattaccctaattagcatggttgaagcagaagctggaacatgaaggattgagcagcggcaggaggagatatagtggtaaatttcaaatgtgtttttttttttttattctttgctaaaatttttcttctacccaattttcattcttcaaaaaattgtattaccttttgtttccatataaaatcctttcttttctaaagaaaaatttattttagtgtttgtttttttctggaaaaaatgtttattttctaattccttaatatattttgttagaactatctgattcttcacctgcccagcagaaaaagaaagtctcttatatgacaaaagtatggaaaaataatttttacttacagttgggtttattataaaatacatcatttttagggttgttcagatcagtgaaaataaacttatttgcttttatttgaataccaggaaaaaattataaatccatcattctttttgcctccttccttattcagtagatgaatgtgtatttctaaatgtttttccaaaacaaaacatctgaatagaaagtatagacattaaatcatagaaatacactgcagacctataataaagccagttctttagaatggtcaacaattttgctataggagagtaataaaagttgacttgcaactttactgttcatcctgctctgttttttctactattaacattgcaatttggagagtatatattattccaatgaactccaatggatttgtgggaaatttaactcttatgtctaatagctcatatgagctcattatcagacatcaatggaaacgagtgaccattcaaaaattttgaaaaagagcaccacaaattagaagtagtaattagccttttggaagcatttgaatcatgaaaagatatgttgcccccttaaatctcggtctcaaaaatcagaaagatacttgtgaagatttatcttgctgtttcattaaaaagcttgagaattataattggctctctcttgttttaaacattttttcaattaaatatatgattagaatgggtacatttcatccagagtattgcactgctgcttctttagtttcaatgcctgtgacaaagtctgagaactgatttgagagaggtgttctctcaggagcagctgcatctctctccattgcaaaatcttcaagcagtgttattaatggctttggagttgcttctgggtgtatgaaggtaatgagttgatgaactgggccctcttaaaatccttgttacacttttctttaagattctccttttaatccgagaaatttgtgcatttccacccattgcaaattgagtttagtttaaacccttcttatgagaaattacttttggagatccattcctgaagggacaatgtgatatttcccttgcctgtcataaattgacctccatactacaagcttagaagtgcccatctcgcataaaacaagtaattggtgtgcattaaattttctttctgaatgcaaagtaaaatgtataggctgtttgctgctgggttgaaaacacacattgttttgcattcgggtacataagtcttttccttgtgaataggagccagagtgattaaacaagcactcttaatatgttaatttataattttaattacaacaatcttgtatatatagtcattagtgaatactaatataaatatttttctacctttttattcataatgcataaaccaatcacccagttacttctctgaggttgcctgtttttgtttcataatacaatctttgttcttagttatgaatgcattttgttcattcctgtcttcaataatccctcattaagctagtcactttctgctccatgctaaaaaggaaaaattatcatgcaaatgtggcatgccatattaaaaagcacattaccaaacacttttgttgctgtccttcaattagtttcccttctttgaatttaattccatttgttgttaaactactgacttgatgtatggactcatgaatctgaggctgctgccaagaaagtggggaaaaaaaatcaaagcctcttcgaagagctgcagaggcgagctgaaatgaatttgcttcacctttgacaagaacacttgaacagcattggaatcctctgatgattcaacttggctaattatccaattatttatttcaagaataaaggcaccattttacaattaaggaagtgtaaagtagtctgagaaatttggtaatgacagatgacttaagtaacttctaagataaacagtatctgtgcaaaacttgtcccaccaattgttttcaggcagcagttggtgtgtcttagcatcagtgaaatcctgagtacactgaaggttttttgtttgtttgttttgctctttcaacagaaattattttacacttgtaaccaacatgtcaaatttccatggctcttaagcaatgtttaagttatatttctcttgattaaaagctttcggttcaaagcaatactttttaattgcctaatgatataagtcagttcttaggaaagaaccgcacatttaggagttcatttgcaatataactgaaaaattcattgcatggcagtaaaacaatttactgttaattacaaggagaagaatttgctgtagcatgctcgcagattgccatgaatcatgcagcactcctagagatttataacagatgtgtaaatgggatgaattagcagggtttaataacagagacacaaatcatgcagacttcaaggagctttaattgatatactagaatgtgacgggcatgaatcactcagccattcaacagcactgtaacatatggtcagctcaatatgccgcatcttaaatcggttggtgagtcgtaggttgtcccatatggtggaagcaatacatttttcatgattaaaaaaaagaatccattttttaaagaaatatgattgcaaagcatgttattgaacagtcttctgaatgccaaactgctttttttaaatgcttttttttttctttaacatggcagcttctcaaaataaataggggctactccttgtaataccagatcgctggaggcattataagaaccaaatcggtgcttgttggcacactcgatccacagcaagcctatagaaaagcgcagctgatgattgctgtgattgtcagggaaatccttcaggctggggcaaaacaaacaaatgaaaggatgatgtcactttcagagaagttcaggaatgcccagctttgtaaattgaagaaaatgagttggatgagagatccctgcttagcagggtaagaaagtggctgtgataaataataccatgacccctaaggtaacaattggatgtaacattttatactaacttcttaattaaatgctcagtcctacaggggcatgtgaaaagaagcactggctggtcatcacatagatggtagcaccaattccaagtcattcttgaagaattatttcagtatctgcaaacaggtaccctggttgaagactggtaactggtagtgtgcaaacatgtttttattggaactgggatctggcagcttttggaaaagcttttgctgcattagtaaatctgacagacttgaaaaaggaatattgcagccttagaactgtggctgccagaatttaatgtcaacaattaaaatttattttgatccttacctagtgtttattactgtttgtatacacaacagaccttactaatacagagatgcactattagatggaattaccatctgttcagagtgaaatgctggcatctgtcttagatgctaaaactaaaatgatattatttctaacaaaacaaaattaactgctttttactcaccaactttaatttgtagtgtgtagttgtatccaaggaaaaggcttgattttgaactatgtgatgacctctgtggccaggtctatatttagatatgcgactttatcaggggctctactggcctttttggcatatgaaaatggcatgtagaaatcacactttcaatacacaattatagcttcataatatactatgtatcctataagtcattaaaacaacacaaccaagctatgtaaaaattgactgaatcagagagactctactatgcaaaatattttgacagatacgccctaaaaaactgcaaggaaagaaattaaataggcaaaaaatcatctgaacaaagttgctataggtcccacagtgacatctttaggaaaatacaaactgtatctttcttctctgttagactattttaaattttctcccacatggacatatataaaaaatttacattcagtgccccctccttttaatttaaagcctaagtatcctattaaaataggtctttagcttttggaagttagagaatttggaggatcaaggacaatggtagtttccatactgatgttagatcagtgacgctactttctgagaagccagacttctattctatatatcacaaaataataaattgtgtcacaccagcatttaatgcatgtacacagtgcattaactgtaactgtagtacatttatttgtgctgcaggagacttgaaaatgatgaagaaatcgatactttgctgtcagagaagcaagtgttacgatgcatttaagtagttaattgcataagccccataaaagcttcaagtttgggtagcaaggatgccataattacagtctgagcaactaccttttattagtggtggactttagggaatggtggttgctgtcatcattgctgctatatgtgcagtttagaaataatggatcctcttctctcttcatgtgtaggatggtagttttgtgcaaattattgtgatcgccagaacaataactggttaaggtagtgtttgttcaccatgttcactgaacttctctaaaagcagggttttctttatgtcacagaacacatagacaaatcatatttgtatgccatgctaaggtaaaggaacaaggtggctgagagctgaaggggataaaccagaggggctcctgctggcttcccaggagcaaaggggatcaggatgtctggtacccattcgtggcttatgaacttagaagtactgttttaaattattcaaccaaagaattttgaaactggaagaggtcctagacataatcaagcctgtcactctaacaattgaagtaaccgaagaatagagagacctaataatggattaaccaatgttccataatcagggtcttaaagagccaatctagagcctacattttctcctttccagatcttctagtaatatcctctcctgaaggtgacttgtcaacaaagaagaaagtggcaaaatatattttattctttcttccctggtcagataatagacagtcaacaagatgatgctgagtcacccctgagagtttcgggggaaaacttttcctctttaagacactgattggtgagcagctgattctgcagcagtctctctgcaacagagaaatcagggctcatgacctggacttcttgtttgcgtcctggtccagtgcccttttgcaagtgttctggcctagcagtgtttggcaaattgtatttcctggcatagttttgcatttctgcgaaaaagtcaaaatcatattctattgacagggtgcttattaagaatgtcttatgtagtctgctccccacccacccctgaaacatagaaaaattgtttattcttaaattcttgtcatcatcatagaaagctgatgatgctttaagatattgacacagccatacagtcttcataggcaaaaaatgaacagattccttaaaaacaaatgaacagattccattttaaagaccagtacctcagaagagctttgttcagcttttagttcttatcctatggtgctcaaaatgctacactacataaattttgcaagtctaaatgtattcatttggatatactactaattatgttataaagtaataaatgctgcataaagaatgcatattataacattttataaaaatatctatacatcgaatagatagacaagaaattagattacccctattaaaaaatacaagtgctattttaaaagtacaagaattttgtacttttattcaaatagacattttattcttagaaatgatggataatgaacattcattttaaactttgtatattatccttagaaataatgaatattgaagattcgttttaaactttacatttacaagaattttctgggtaaatacagatagattttgaatatagatgaattgtattccttaatcatacataatttgaaagatttgttcttgtaatgatagcaccttatatttgtatagaaacttgttttctaaaacataaagcaaatatgtatattgttgtagaagcaattgttgtcaatgtatgtcactgaaaatgtatcctcatgttgcagatgggaaagtgggagcagatataaagggatttttctaagatcacacagatttagacattaaaaagtgaaatataatttttaaaagtctaccaaatccctttcattattcagtgttgtctcttaacgaactgttttgtaaattaacaaatctttaaaagtcatatctacttttacctatagttccttttccttgaaaatctgacgaataattcatcattaccccaatctcttggtgattctatgtgcatgtatgtgtgtgtgtttaatggttcagaagtatctatttttcttcttattctacttgtgtgtatgtgagaccagtctagtttaattgattgacaatttcacttaattcccccttccagccttagaagaactctgaaaagaataactcagtaggatgttcaccctttcaaacaggcttagttgactcctccatgtgaaactgtaaaacacacctactggaatgttttttgttttgtttttcttttaagcaagagaataaaaaatgtactctagttctattcattctcaggaattgacttctaaaggacagtcccattgctagatggaataattcctctgggaatcaagaagtgctctactacttaaagtttaaatggtaaacattaactttaatggactctcaagaatttccctattgattagaatcactttgccaaattaaaaaaaaagtgtgctctaattttcaataattattacacaaaaacgacagagttgccagaattccttttgtttagttttgtttcctattactcttaatctatattcctgtttaagacgtaatttttggattatgctactgatgggggaaggaatttgatttctgtggtggtgctgagcttcaacattatctccattgagttgagtggttggagtaaagtagagatgtatcaactttcaaacaaatgggacctggagaaaggctgctttcaaacagcaatgaaattcttcagcttttaagaagcataggaggcatattcatacttcttctcaacatttagttaaaatggaaatcctatcctcaacacaccaaatatgtataatttgtgatgctctgtctacatctttggtgtccagtatggtagtcatgaatcatatgtggctatttaaattcaaaatacagttaattaaaattaagaaatttgacattcagtttctcattctcactagctacatttcaagtgctcaatagtcttattataaggctagtggttaccgtattaaacattacagtcctagaacatttccttcattggagaaagttctattggacagtactggtaaagtagtttttggctattggatattactaggttagtagtttatgaaactaaaaagttcaggtttctgtgtcccaaaaccctagggaatctagcaaatttcaatttaaacattatgtaattggttctccattgcttccctgagcccaggactaaaaaatctttggcagctttcctttcctagttgagattatagccaagaatggcctgctaaaatcttaatacaaatatgtaactctaaactctgaagagagactctgggtgaagaaatttctgaatggcttagccttttattttgttttggattattttgaagtgagatcataacttgtagaatgaaatctttgagaacctaccatttaactgatttttagcagaaaaaaatgctaagagaaattatgcatataattcacagattcatacatatataaaaataaaatatcacatgggctgcagtggcagaaaataaccagaattgttaattatccttctaacttgatgaactttttgctcagtgccttttcttttttactaaaagttaaaatagaaccaaaatgaattgtttctttttgaaaagctggccgaaggtctaaaaagtaacaaatactaattgttctaagctgctttacggtgaatttcctttcatggtttaagggcttcaattcttatatccacatcattttgatttatatttattgaaacaggcaatgactttgcgtctgtgtatggctgtgttaacacaggtgtaaattgaaagtccacagatgtagtttgggcccttaataaataggctcggtgattatgacatttgttcctttctccacattcacctctcaaatccagcagacatacttaaagggggaataaatctcagctcacaaactcaactgtttaagggaaaaaaaaatcaaaccaaaacaaaccttcattttcaataaatcagctgttaatctgaatgagcaagttgtagggaaaaccttaatctccgtgactcctagggtttcccaggaaccttcaaagaattgccagtgtcccaccacctgaaaggatggcaaggtcccagtgtatgcaagggcatgaggtcactactgctccaaggctaagcccactgctggtggtggggtcacttcagggccagggtgctctctaggaccaagaggctgaccaaagttagttgcctggaccgttgtgtgtaaactgctgaactcacaggcttgttattttgtgctgatgctctgtttaacattcagagtgctattgcttgtttgctttcatttagatcagtttttaagctttaaaaatagaaaatagcgtataaaaggagcttttttgaccaaagaagatatacagatggcaaatacacatatgaaaaatgttctatatcatatgtcataaagggaaatgcaaattaaaataagataccactacacacccattagaatggccaaaatctggaacactgacaacaccaaatgctgatgaggctgtacagtagaaggaatgctcattcattgccagtgggaatgcaaaatggtacagccactttggaagacagtttggcagtgtcttgaaaaccaaacatgctcttaccatatgatacagcaattgcacttcttggtatttactcaacggagttaaaaacacaaaaccctgatatataattagatgtacacatatatatgcacatcatagcagctttattcacaattgccaaaacttggaaacaaccaggatatttcatcagtagatgaatgaataaataaactgtgataaactatgctacatccagacaagggaatattatttagcattaaatgagctagcaaatgatgaaaagacatgaaggaaacttaaatgcatattactcagtgaaaggtcagtctacaaaggctacatgctttatgattccaactatatgactttctggaaaaggcaaaactacggagatgagtagttacctggggttggggggaaggagagatgaataggcagggcacagaggatgttttgggtagggaaaattttctgtgtaatagcataatgatggatgcatgccatcatacatttgtccaaacccagagaaggtaaacaccacgtgtgagccccaatggaaactatgtactttgaatgaaaatgatgtgtcaatgcagatttatctactgtagcaaatgaaccatttgggtgccggatgttgatattggaagagactgtgcatgggtggggagatatggtagaactctgtaccttcttctcaatttttctatgaacataaaacttctcttaaaaattaagtctactgggcgtagtggcacctgtctgtagtcccagctacttgggaggctgagacaggaagattgcttgagcccaggagttccaggctgtagtgagctatcattatgcctgtgcatagccactgcactccagcctgggcaacaatgtgagactccatctctaaaaaaaaaaataaataaaggttacccctggcacattgcctatggtgtagccgtgctccacaggagcaatcaaaaacaaaaataatgaaagtctttttaaaaatgactttctgatgtatttttacacaagcacaaagttttggcaaactcgtgttaatattccttcattacccattggttggcacggattatgctttgcctgtgtaaattacagcacggagttgatgcctctttaaggcaaggggctctgccctatgggtttagtgctagtcattggctgtaggtttcactgcgggatcctgtggctcctgggtgaggcagctcttactcagccaagggaagttctacgcagaagggggcagccatgagccatcagaaaccaacgggcacagaaactgggccattggggtacctgcttggtagagggactgtggttggggcaccacccagagtacagcagctactataatatataagatctattatttagctaaaaagaatagagaagttattttcaagaaaaaatttaatttgaaagttttgtgtgtagtatattggccatttaaattttgtttcactgcatttaagataaactctatattgtgttttcagttcctagagccatacagatacttgaaaccacaactgatttgatttgaagtgtgatatatacaaatacatatatacgtatatgtgaatatgtgtgtctagagacagaaaccaaattcttgaatataacaggtgttttctaatatttagcaccagcacaactgaggccacctctggttaaaggaatcaacagcacaacaatccatcttaggtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggtaagtgtgtttgacattgctttatttaggagacacgaagctccaaaatgttttctatattttcatatccctttacaatgaatttttattatacctacttagagaaatactaattcagccctttgatagcttttgcctgattgtttcagcatgtccatctttttagaattctggggaaaaaagtcaggtaagtgaaggaaaggaaaaataaaagatgaagatgaagaagcagccttattggatcaaagtatgtgctttgtatttgtctttttgtgaagtatgtgccaggacatgtttcttgaaatattattcactgtgttctctgagcaaatgagtttgcaaaatgccctcatgctattggagattctcagtatgcaccccgttactgaaactccaaaaagcattgtaagaaagctattcaactttgcttagctaatcatgcctaacagatatttgatgtaatgttttctttttctttctcttgctgtttccttcttctttttttcactgtgacaacttaatatctcatgttctatgaagaacattgtggggaaaactaatcccagggaaaagataacttctctaagccaggactatggtaaagcaagtgaggctcttgtttcggtcacaaaatttaaaggcactaaaaaactcagtgttaatgtaaattttaatgcaatatttttaaaaatgaaaatcaatgtgaaagcactataaaaatattatcaaaagcttaaataaagacagattgaactctgtaccagcacaatcctgcctcactggccttaccctcctcctggccttactagtaccgcaatattttggaagtcccatgacctctgtgacttacagcttctaatagcatgatttcaatatagctgtaaaaaaactctacttatggtacaccatttttccaatttttaaaaaaatttacaaagtataagatatatattattatgtaaactcataaagatgttcatttaatcatccatgagaaagtcattttggagcaaatagctagtctttaaaatattgcatatgtgaagacaatgaaatggaattcgagctataaaaatttgtattgttttatttttacttaaaatagtaaatagtttgcttttcattgagactggctgctgatgcaccttggtaatgaatcatgattatattctaactgagatatattgagattaatgcatgattaactactctctcagtacatcaaaatcattgcagagtattagaaattgaaccattgagctaaaaatgctcaacttctgctttatattcttaaaatggcaaaaaagaaaagaaaaaaaaggtaaggaaaaggaatacatgaataatagtaaaactcttttctcaaatgaaaatggaaactacctccctgatccaatatttggcttgagatgtgtttcttccaagaaatagcatccgtttccattcagctgggcatagctgctgcaaggatgtcagcttggatttgcaggctagccagcagacagatttttgatgggatcacctactgttgttgcagtgaaagatagaatggcccgtccaccgttaataaatttggtcatcctcgctatctcccttgctggccttatactctgaggtgcaagggctaggggcagatgcagtgtctgggaagttttccaaattcctctttaaaaaagttaggctgtaaacactggcctcactaagcaggatccttctgtctataacaaagcctccagctgcacagaaaatatgcttggagtacacaccatttgaaggacaaggcagggagatcacaattttggcttgaactactccctggagctttggtgattcctggagaatgagaagttcttctgtgttcaggcatgttctgggacattgctgatgccctttttagtggtagcttggctttacttttaagacccctttaacttttaatataaccatgtatatactaagttattggtttgatcctttggctgacttgccaggtttggctgaatgattttattgagttgtaccgaagcctaactaaatgtacccaattaatgagctaggacaggttttcaaaaccaactcaataactttctgtaaacttgcatctttcctaaatagagaggtaagcatataattagcatcttacattattcttactgatatattatcctatttaatccctctgcaaccctataaagtagctctttttaccctcgtagtacaggaggaaaagaggctccagtgagtgacttgcccattgtgccacagctattgaatttcagggtggaaacgtgaattggagccttccaaatttaaaggcaaggtctctgctacagggtggaaaggaacttttgtagactgttctttggaagtgatagaataggaagtatacaaaagtaagaaagagggataggaggtgaaataattatcacccaaatattccttatctgacactgctaaactttttggatttgtctttcagttagtttcagctcacaaacagcaagtagtgttggcattatttattcatttatttgtatccccaaagacatgtaggcatcaggtttttttttaatagcaattaaacccagagtgttactagaagctagatgtttaaaatataaataacattatgtgaaatgggctgaagtgttatgcgttaaaacagtgctttcaactcacattcctttatatttcattcagtttttatattctgaggcaaatttaatgagcaaatccttgaaacctctaatatgatgaattacattttaaaagttaataactttaagataaactaagatgtcctttgttttgaattattcaattcaaaatctcaaacttcaactaaaatgacttctgaatagaaatatcaattagtactcaaatacaaatataaggttgatgtacataattatacatattttatatatgaaaagataagttagattgtacccatcaatgacaggaattataaacgcattcataacacatttcatggccatgaacattatgttgcaagtctcagtaagaaatatctcattattgtagtacaagaaagggatctcttacacaacttatgcctctttcatatttgctttaaatatttttatcttacacaatagaaagagaataattcaagcatatgaatatatgtcctaaaatgttgtttaatattgtaaattaccaagcttaatactgtaaataaaccctgtcaatatctacctttgggcagaataaagaaccagataaagctattttgggacctatttttgcttccttttcttttctgatacaagtgttcttttaaaaaatctaatcttcaggaagaatgtattatcagtcatttacatcatagtttaaatttaaaataattaactctctgtatattattatgaggacttcgaagaagattaactgataaattactttcaaatccaggccccattatttattagctaaatgtaattagacaactcatttaatcattttttgtgcttctgtttccttttctttaaaattaacataattccactgacagtattggtatctagcaggtaggtgaggatttaaagtagatagcccacctaatgaactttgcacagtgcctaccacacagattatttagtactcattaaacattagctattagttattattcatttaataaatatttattaagtgcctactatgagacaggagctttcctaagtgagagtattctgcagttataaaatcagcattctattaatttatttgctgttacacatgcaaaatatgtttgctcaaatgttatatctagggcatgagtaatatgcaatattccatattaaaatgtgatacttaattttgctattgaaaatagtaaaattaattgacttagtggtgaggacttgggcaaactacttttctgagtgtctaatcttgctcatctattaaattgaggattttgttgcatgatcaatgttctaacctctaaaattccaattctgtgaacatagaatgtttaggaggccccacaatccaaaatacaggctgtaatcatggcatctgtgagttaaaaaaacacctagagtttaaaataaattgttttctataatattttgtttattaatacaatttaagattgatacaaatttactgcttttctctaataatttaagaaatttagtgatatgggcagagttcaacataaaatagatattcaattattgggtcatatcagatgttataaaaaaagcagaaaattaaaatagtttcgtgatcttgtaattgggcaatgatataaacaatcatggtgaaacagtgccccagttacatggggttaaaaatactttcttcttccaacacagaaatagcaaatagagcctcccctcccatatgcaactagaaggggatatcattgtgcctttggagagaaaaaaaaatcatgctcgtttttttcaggaatgcagagtaaatctacttgatttatacaaagaatttagttctttccttgtaatgctagtaatccaagtggaacctggtaaaaacagcaagtaaaatactgctcagattggcattccaaaggtgaccctctttctccttgtcacttattttttcctattagcgaaaacaggtccatgatcatttgggggaaggtttgactattgtagtatccagatgccaatcacaccagccttttaaactgcctttactggtgaccctgcccagaaatcaggaactgcctttggggagatctttgtagcaaaccactggggagatgagcacacacatgcacctggatataattcccttttatttgtcttcacgagaaatgtgattactgatgttgaatatcttgcagatgagaactctatacagtttcttcataataatgatgttcaaggacactaaatgattgtcatacatttttgtatcatagtattcaccttcccaaaaatggttgaactaaaatgctttagaatacgaaatgcaattaattaccaagggatgaaaaaagaaatgcaaccaccaaaaatcaatatgtttaagagcatattctttatttcttttactccataatatttatgccttattgttattagtcttcttatttttagtgaattgggacatttaagcacttcattaaaagaaagctgattataagcatttatagtgaaggtgcaagtagggcaaacttcttcagatagactaattagtaaaagcatattaattctgaccttcaacacccttggtgtcccactatttgttttccttggagtgggagcaagtattttgacagaaagcgcttgaaaaaaataaaaaacaaaacaactaaacaaaaccccagttcttttcaagacagatttaaatcacaaattttacctaacctttgatgttagatttcagccctagttattgaaaaacaaatataataatctactatgtgtcctagaagtttaatgaacaggcagtaattatactaaaaaagtaaaggaaagagtaagaacatggtatgtggcagcaaagtaaaggagaaataattctcaggcagtgacaaaactctgctgtgttttctgattatgaaacaatcagaagagatgagaatggttgagttaatcagtttggactgaggacaaggatcaaaatgcatatcttcttagaataacagaagtcacactgactcatgataactagagatatggagatgtaaatgtcaagactgtttattttttattatatttagtagagaggtataagtaagttctcaggaaatgccttcaggtggcattgatggcactgcgagatgggagaggaccattatttccccattcatcaactacatcataagaccaatttaagaatgcatgtgttttaacccttgccttttaaaagtgacttattttgaagtacattcctgtaagtctcccttttttttgaaatattaatgttaggtaactggtaagctgagccaacactgaaaacaaactgtttttgttagctgttagcagtattttagttaacttaaagcatctgtttttgtccatcactgttaaaatttttcaaaatgcattgtcacctgatatataaaccacacgtgtgttcctatatactcatcccacatgcataaacatatgttttccagaaggtctctgggttttccgcaaccactcaatgggttctccttgcccactgcctagacagagccagtttatcaagacaggggaattgcaatagagaaagagtttaattcacatagagcctgctgtatgggaaacttgagttttattattactgaaatcagtctcttggagagtttggggatcagagtttttaagagtaatttggctggtaaggggttgggaagtgggagtgctgattggttgggtcggacatgaaatcctagggagtcaaagctgtcctcttgtggtgagtcagttcctgggtgaggaccacaagatcagatgagccagtttatcaatctgggtggtgatagctatttcatgagttaagggactgcaaaatatctcaaacactgatcttaaattttccaacagtgatgttatccccaggagcaatttggggaggttcggaatcttgcagctggaggctgcacggcttctaaaccatcattccttatcttgtagcaaatttgttagtcatacaaaggcagacaggtccccaggcaagaagggggtctatttagggaaaaggctgttaccatctttgtttcaaaactaaattgtaaactaaattttttcccaaggttaggtcaacctttgcccagcagtgaacaaggacatattagagtttataagtaagatagagttatttaggccaggtctctttcactgtcataattttcttagttataatttttgcaaagtcattttcatttctatatagtctcaaatatacctgctcaaattgtccagtgtcttttctgccagtatgttggcattttggaatcttttcaaagacttcattgcttaaaaaaaatgctgttgcttaatgatattttgtatcaatataacacattaattttaatttccccttcattcagcttaaatgggttggaaaaggaactttgagcagaaaaagaatcataattggtcagcaatggtagtgaaactagcacctttgaagatgattgatttttgatttagtaagatgaattattttgtgtatgttttcttgaaaaaaattagttaaaacatttaaaaatgtatagttatagttattttataccagttacagcactcttgaagtgtatagattaagttcctttctattcagatagagaggaatctgggaacatcattgtcaaaatgccatctctttcaaaacttggttccagtgctctaaagaaatgttttagaagattatgcactaatgttactggcggcaaattcatatagatctgtagccacctcaatttttgcattctcagaagaaagaatttgattgaggggacataaggcatattaagagaccaagacaaattttagagcaagagtgaaaatttatttaaaaattttagagcaggaatgaaaggaaataaagtatacttggaagagggccaagtgggtgacttgagagatgatttgacctttacttggggttttatataatggcatgcttccgaggtcttgcgtcccttctcccctgattcttcccttggggtgggctgtccacgtgtacagtagtctgccagcaattgggagaagttgaatgtccagtgtgtttactgaagttataggcatgctcacttaaggcatgtttccttgccagttaagtgttcccagaaggtcatataccggttaagcgccaacattttgcctcttagtgcgcatgcttgagcccactcacccatctcctgagatctcattgggaagctgctgatcacccgtctcaggtgtttctatctatagggagactgcctttccctggcactggctgtgactgattcttattattttagagagatagtgtaacaattatcacctgacggttgcctgacatttctggtggggcgttgtggggggcggtgcttctctgaccctgcccatagtctaactgccaactgtaacactaacagtttcattgaagtgggggaaatgttaagtaataatatgaaaaccatatttaaggtatatatatataaggaggctcacaaacatagccataggccgtttgtttggagctttgaaaagggaggctcagttccttgactgatgagcagtttccatttggaaattctttgactttagtgcaacttcaaaataaaggcatgagacagaaggagagaggaagaaaccctcaagccatctaaagtcatctctggcaatggtggccatatcattttcacaaaaaaggggcatccttggggaatatcataaaggaagaataaggacttaagggaaatgtgtgggaatgattgactgatcctccctccagcagaaaattaaaaatcaatgtagatgcatttttctcagcttcttcccttcatttttttcctctcctgaaacctgttcctccttccgtgtgtaccatctacagtgaatatcactattgccttaggcggaaaccttggaactctccttgaattggcacttgaactattcactcatttcctcccattctattaatgattcctcctctggccgttcttcctcggatacatctcttggaactacctgctggtcctacgctactgcctagtccagacctatgttgtgggcttctctgccaacagtttcaatcttctccaggctgttcttcaaacgaattatttttattggcattctcttgtgtaaaaccttttaatggtttcccagcgagagatgcccttcacaaacccttttctgcttacctgctttctacctatatacctcctcatctctcccaccaaggactggtatactctctagctctagaccattttttagtcccagtgcttgaatatagcacactctctcagatgcccatctctttgaacatattgatacctttgccgggtatgccctcatctatttgcaagtacttcgctttcctttcacctggctaattgctactcatcatgaaagggttagcttagctgttcccctaaataaacttccagcaaccccagcctcctcccatgccaaatctgggttgaggacctctcttatgtactactatagaaaccaacaattactctattttagctcttaccgcattctattaagacaggttgttcagggagctaagctatgaggacgcaaaggcataacgatgatacaatggactttggggactcaggggaaagtgtgggatggggtgagggataaaaaaaactacacattgggtacagtgtacactgttcaggtgatgtgtgtaccaaaatctcagaaatcaacactaaagaacgtattcatataaccaaatactgcctgttcccaaaaacacctgttgaaaaaaaaaaaaaactggttgtttgcttatctatgtttcatgtagactgaaattatgactatctttttcatgcttaacacatttgtgtcttgcacggcataagacatttaccagatactcaataaatatttattaactaaatgagtgatagaaaagagggaaatccaaaagatggatcacttagctgtaagaattatttaatggcaaaattcattatgcttttgaatatagttcacatttttaaatccacgtttttgaaagtattgatggtttagagtgataactcaatttgtttagtctctattggccttagatgtgtaagaaaatacattttaaactgtatagtaccagagacaaaaagaaatttcttgttaatggtcctcagttgctggcaaagttacttgtacaccagttgttatagctagagtgttatatcagaaattgttttctgccccaccatagctatcacattgtgttgctgaaaactaggtggttgcacatctcttagatacatgatctccttaggcttattaaattttgaggttaatgaatattttgacacttttacctatacatatcattagggcttattgcaataggtttaagatgacagtcataataaacatatacagtacaataaaaagcacttttaatcttgaaagtgctttaaaaacaacagtgatcaatgctatggatggattaacagcatcatgctgattgaattctatttcaaggacaatggaggtattgatgttggcagtctagttcagaaagtggcaatggctgtagtaaatggtgcaggttctggagtcagactccccaggtttcaaatctggctccccaacatgctggtgtgcgactttgcacaagtcattcccccagtgtgaaactcagtttcttcatctgttaaatggcttattgtaaggtttcaatgcaatcactgtaaaggattagtacacagtgtcttagtattgtgtatgcatttgtgaccagcattctgtaattctggacttcaattatgtgcctttccattgcatacatatattttatgtccctaagtcacataaatcttgttgatacttctttatgacctctctctactacacggtactctgatcattcactttattttactcattctgtgaacctctgacctgttttttgttgtcattgttacctttcttcttccactagaagcatacatgttctgcatctcatttctccacatctatttaaacagccaactttaaatgttatgtgtacttataaacctaactctattattccccctgtcttcataatcagtcttctcgaaaactaagactctctatgtgtcattttctcatggatcaattactcctcaatctactgtcatttggattcttttcttccacttctttattgtaaatactttcttctagattatcaatagttttcaagtcagagaactttccttaatcctcaccctatgtgccaataaataatattggtgccattttttccttttaaaaaataagaagaaactaaatatttctcactaggtttctccttctattttccctaaactgtgtttcaagctttgatattgctttctacatccacctttaaatggaagagttcaatcactcattcggttcgtatgcagtttttccttatttcactccactagctgatgttatgattgctgtcgtaaaaaggatactgagcaacacaagaatgattcctaaccttagggagcttaaagtcttgcagtgaaatcatgcatcaaacatgtaattaagtaattacaagtgacttctgtctccagctatgaagcatatcaaaaaatcctcctgctgagaaaagaaatagaagctggaaaaaatttctcaaaaatatggttaaagacataagtgagtaacaaaggcttctaggacttgtgggatcaagatcctagatataagaaaaaccatgtaggtgagccttttaaattatctttgtttttccttctgttttgtttgttaattcctctattgcatagtcttagggaaaaaaaaaagacaggcaaaaaattagagtctaggtggggtcctggtatacatgccaggttttcaattgaaatcctagaagagcaaatcattaataggctcttcttcctcagataaagcctcaattattcttaactactaattatactgagataaaagttatttttttaccaaaaatatttagatatttgctgaaagatcacatcaaccagagtcccagagtgtgcaattttttcctatacaatgtcgggcattcaatcaaatattaacaggcataccagaaaatagggccaaataaccaaaagataagataaataaaataaaaaatagaaacatatcctcaagtaattcagatatatggaaatatgtatttgcatacacacataggcatatacacacatatacatgtagatatatatgcatatatccagacacagactttaaaataactataattaatattatcaataaaatcaatgaaaatgttcagaatttaagtagcaaatgggaatatattagaataggaattttagagcggagtaacagctgaagttagcaactcagtagataaaataccaattccatccctgataaagtaaatagccttgttcttaatatcgtatgcaacaatgtaagttgggaacaaaatatatatgaaacacctatttgtagccaatatatagcaacagtgcagagctattatgcttaagtgaagaaaagcaaatgaactgagttgcacacacctggaattattgagctcaagcagagacattagtatatctggtaaaggaataaaaactggaattcagggctacaaaagtagatttggagggtaggttcccagagagaagattgatgctgaaaaataattcaaaaattctgtgtaacaattcttttttgggtgcttggccaacatttagaataatcctatgagaaacatagtagagaagatctgcttggtagttggagctaagtagagatttcacaggcaacatagagctaaggatgcacacatggagtttggacttaaccacagtagagaaaccttggtgaatactctgagctttcactcgactctccaaaagtccgtcctttatgagtaaattcccatgctttaggaataagggctattctttaggaacattgagataattgaaacagattcaccctagtgaagcctaaagccaaggctgagtaaggtcgaggtaatctggtaattttacttcccgtcaaaacagaattttgtattcattagtaaaaggtaaaataatccagaggttttactatgcgtcatccatgaagtgaccaataatgaaatgttaatagtcgatagaggcagacaaagacttcaaaataacttcagttaatgttaagagaaaataaaggacaaggtggacagaaaggatgataagataaaaaatatttcaatgcaaaattgaaatctgtacagtaattaataggaaaaaatggtatgtaaagtaaaatacctgaaatgaagagaatattgataagttttgccaatgaaacattgcagaaggcaagattagagaactcaacggtcaattgtaattgtccaaactgaagcatatcgagaaggaaatgaaaacatgaaaaaaagaacaatgaggtatttgaggacccagaaggaaagagtgaaagaatgagacaatagtaatattgtagaatagccaaatattatcaaatatgaaaaataagttcacacatagtttaacaaagtttagcaaaccataaggagggcaaatataaggaaagccatatccaggtatattacagtcaaattgcttaaaataaaagacaaagaaaaaccttcaaaagcacctggggagggtggggagacttattaccttcagtggagcaaaaataagaatgatgtctgagttttcaacaacaacaataaatgaatgccagaatataatggaatgatactttttaaatgctaaaattatttttttaacaataataacaacaaaagaaaactaccagtcaagatttctgtacccaggaaacatatccatcaaaaatgataaaataaaatatttttcttaacaaaagagttgaaaaaagttatcatcaaaagactggcattataaaaatcataaagtgtattaggacataggaaaagatcccaaaaggaagcacagagctgcaggaaagagtgcaaacctctagaaatggtaactaggtgtgtaaataaaaagtaatatttatgataaaaggcataaaaatcatactttgaagttgataacatgtaagaaaaaatgtatgacatcaattattttgtcacaaatgatgacggggtctatatggagctaaactgtggtaaaattcctaaaaagttatggaagttgaagaattaataatatgaagtaggccatagtagatcaaggattcagattatgatgccaaaggtaacaaccaaaagaatgatttagaaaattaatgtaaggaaacactaaatgttaaataaacacaggttaagctgataaaggagtttgagggtggcaagaagaagccagaaacaaagagcaaatgtggggaataaaaggacaaataccactgtggtgaacataaactcaactatatcagtagttgcattaaatctaaatagtctacccaaataagcataaaagttctcagattgatttaaaaaataaaaatatatgttgtttattcttataaacatactttaaatataaagacaaaattcgaaaacaaagaaagagataagatgtattgatatatagatagattttaagacaataaatgttagtagacaaaatggaggacatttcataatgacaaaaagatcaattcaatagagggacatataatcctaaatttaggtgctacttatagtttcagatatgtatataaaactgaagttgacagaaataaacagagaataaatatatcctcatagttgaagatataaatccccatctaatattttgacaggaaaagtacacaaaatattagtataactatcaaagatttgaaaatgaataaacaattacatctgtatataaaacatgtgacattttataagtgttgtcatatgtagaacatcacttccaacaactatataatatgcatttttgaggaacacataggacattttccaaatagttaatatcctgggctatagaaatcgcataatttttttttttaagagacgaggtcttactgtgttgctcaggctggtcttgaacccctgggctcaagcagtcttcccacttcagtctcccaaagtgttaggattacagatgtgatgagccactgcattcagcttgatctcataatatttcaagttctctgacaactgtgagattaaactagaactccaaatctaaaacataatccgattggaaaatatccctggctcaaaaagaaattatggaaattaaaaattatttttatctaatgataataatgccttaatacatataaaaacattgtaggatggacaatatcaggaatctgatattgctttatagctttaaatgcatatattagaaaaagggaatagttaacaatcaattagcttcccactcaagaagaaaccaggaaattaaagcagcatatgacacccaaaaaatatttgaataaaagaaattataaaaataagagaaatcaatgatatagcaaacagaaatgtaatggagaaaataagaccaagaattgattctagaaaatttggggaaaaatttctttgcaagtgatcaaggaaaggagaaagtacagattactactctcagggatgcaaagagccattactagaaatcttacagacattaaaaaaaataataatgtattaagaacagcactacgctaaaaccttgacaatacaggcaaaatacagagatcctttgcatgggagaaaaatctccaaatttaaactgacacaagaagatctagaaaatctatgtggtcctagatgtgttttaaaaatgaaatctatagttaagtcttttacataaagaaaaccccagggaaggtggcccgattggtggatttcatcaaacaattacagtagaaataatagcaatcctacaaaaaaactcttacagaaaatagaaaattgcaatggtttctatctcattttatgaggtcagaagaacttatacactaaaatctgacaaagaaattaacataaaggaaaacacaggtcaataataatcacaaaagtagattctaatattctctgtgtgtgtgtgtgtgtgtgtgtgtgtgtgtgtgtacataaataaaatgttatatcatgaccatgcaggttttattccagtagtgtgtaatcttttcaaaatgtatgtgattcaacacattaacatagtaaaaatgaaacattctaaattatcaccacagatttaacaaatgcatttaataaaatataataactattcataacaattctcagcaaactagtaatgaaagaacacatcctaataaattgtttttgtaaaagacctctaatagtaaaatatcaagtgctttttcccagaggtcaggtacaggacaaggaaattcactatcaccacttttatttaatgttgtactggaagtatagtactagccagagcaatatagcaataaaataaataagtattaggtatgtcaaagaagaagtaaaccatctttatttgtagatgtcattatttttattgatgtcaaaataatatataaactattcagtttactcagtaaacttagaaaagtgtcgaataaaggtcaatgtacagaaatcaaatgtttctattgaatagcaaaaaacaagtagaaaatgaaatgtttaaaagtaccatgcttactagaactaacacacataaatgacttagaaacaagtctgctaaaaggtaatgtaggacctccactctgaaaactacaaaaaattactgtgagaaattaaagaccaaataaatggaaagttacgccatgttcatggatctaaacacttaatattgttaaatagcaagtcttcctagtttgatctgtagaatccatatagtccctctcaaaatcccaggatttctgtaaaaatttacaagctaattttaatatgcacatgagagaggaaagtacttagagtagccaaggcaatactaaaaaagggcaaagtaggaaggcttatgtatcaagactaactataagactgcagtaggtaagcatgtatagtataggcaaaagaacagataagtatagtaataacatattgccacataaataccccaaataaatacatatatatgcagggcacagtggctcacacctgtaattccagcactttgagaggccaaggcaagagtattgcttgtgctcaggagttcaagactagcctgggtgacatagtgagacctcatctctacaaaaagctgaaaaattagctgggcatggtgaggcacctgtagtcccagttactcaggaggctgaggtaagagaatctcttgaacccaagagttcaaggctgcggtgagccttgattgcaccactgcactccagcctgggtgacagagcaagatcctgtctctaaaaaataataataatacatacatacatatgtgctctaaaaagcacatgcaaagttgttcatagcaactttatttctaataatcaaaaactggtaacaatccaaatttctatcaacagtagaatggataataaattataataaatttattcagtggactgcatatagaaataaaaatgagccaactattgcttcagagaacaatgtgggtgaatcttataacctgttagtgagtaaaagaagctagaatctaaagagtctagtattctatttatataaatttcttctttttcattttaacatttattttaggtataatgggtacaacatgcgggtttgttacttggctatattgcatgacgctaacgtttgggctatgggttccattacgcaagtagtgagcgtggtatccaataggtagtttttccaattacagtcccctccctcccttccagtgtctgttgttctcatgtttatgtccatgtgtgctcaatgtttagctctcacatataaatgaatatgtagtatttggttattgttccagcattaattcacttagaattatgaactccaactgcatccatgttgctgtaaaggaaatgattttgttcttttttgtgattgggtagtattccatggtgtatatgtaccacattttctttatccagtccatcattgatgggcacctagattgattctgtgtctttgctattgtgattagtgtagcaatgaacatatgagtgcatgcgtctttttggtagaatgatttatttttctttgggtataacaggattgctgtgtcaaatggtagctctgttttaagttctttgagaaatctccagactgctttccacagtggctgaactaatttacatttccaccaatcgtgcataagcattctctcttttccacagccttaccagcatctgctgttttttgactttttaataataaacattctgactagtgtgagatggtatctcattgttgttttgatttccatttctctgacaattattgatgctgcacattttttcatgtttgttggttgcttgtatgtcatcttctgtgaagtgtatgtttggctgggcgcggtggctcacacctgtaatccagcactttgggaggccgaggtgggtggatcacgaggtcaagagatcgagaccatcctggtcaacatggtgaaaccctgtctctactaaaaatacaaaaattagctgggcatggtggtgtgtgcctgtaatcccagctactcaggaggctgaggcaggagaatcacttgaacccaggaggcaggggttgcagtgagccaagatggcaccactgcactccagcctggcaacagagcaaaactccgtctcaaaaaaaaaaaaaagagatagaagtatgtgttcatgttctttcccattttttaaatggagttgtttttcttttgttgatttgtttaagttccttataggttctgcatattagaactttgtcagatgcataatttgtatattctgtaggctgtctgtttactctgtggatagtttcttttggtgtgtgtgcagagacactttagtttaattaggtctcagttgtccatttctaaagctgcaaagtgaaatcagtggtgacagaaatcagtagatggggtaataactgaaaggaagcaaaaagaagccctctgagattctggaattattttataaattagtctgagaggagtttataagtgtagatttattttgtaaatgtccatcaaaatataccttgataattagtgcactttatttttgttatactttactttgaaaagttactgaataaatgtttcaagcctgcaaagtccaaaaataagatgtgaaaaaatactgtaacataacagaagcactcaacccagtctagaggattagtgaagacctctccgaggatgaggcaagttgagttagctaggccaaaaaaaaaaaaaaaaagaaaaaaaaaagaaagaaagaaagaaaaagaaagaaggaaagtaaaggagtccaggtagagaaagtatcatgtatcaatgtcttaatgtgggagatgacatgtacataaataaacaaattagtaagcaagaaaaacttggaaattctaatataaattagattcttgccagaagggtgcatggtgaggctgaaataaaaaaggggccagatcatgcaagggccatcacattgaaaattttgaacgtaattttattcatctttataagaccactgtggaggttacagcctgataccaagaatgtttttaagaagggcatgctgatattttcactgatattgtacatgtaccattcatagattgactcactaaaagttgcaattttatttaatcatctaataagattatttatagaatgtctgcaaaatgttagaagatcttccttataagaattagcatagctgaatggtttaaaaaaaaatgaaattctgaatcccagcatggatctattgcattcttgcaattgtccaaggcaaaaggttctgcttgcctgcttcataaacaaaatcaattaaccgagactgcagcattgcagtaaaaagtttaatttaagccaagccagccaagtggaagaactggagttatcactcaaatcagtctctctgaagtcttgaaggttaggatttttatggataatttagtgggcagaggggctagggaatgggtgctgctgataagttgaagatgaaatcataagagcatggaaaatggtcctcctgtattaagtctgtctctgggtggggcaacaggatgggttgagtcatgagtcattagtccaggtgggatcagtttgaaaaacatctcaaaaaagcaatcttgggttttacaatagtgatgttatctataggagcaattggggaagtcaccaatcttgtgacctctgaccacattattcctgaacagtaagcaattataaaaattacacctacattttagcagcattcaggcccctcccgtaatcctattcttgtggcctttcattagtcttatgaaggtggtttttagtctctgagaagggaggaggttagttttagggagggatgatcatctatgatcatctttgctttcaagttaaactatgaactaaatttctcccagtgtccaggaatggccaaagacagcttgaaggttagaagcaagatggagtcaactatgtcagatttctcttactgtcgtaattttgtaaaatcagtttcatcctaatctctggagaagtacctagaaatttgcatttggataagatatacagatctacactattaaagacagagctatcttacccacccccaccccagctatttgtctaagggaaatgaaacaatttgtacatacaaaaggctggcacacacatacgcattgcgcctacattcacaagagccagaaactggaaacaactcaaatatccatcagtaggtgaattgattaataaaatgtggtatatgtatgtgatgaaatactagtaagcaatacaaaggaaagagcagaagaacacttaatcgtaattccacttatataaaattcttaataataattaatgtatagtgacaaaaaggagatcagcagttgcctaggcctgaggaggagggggtgatggaaatgctgtgtaacaatcaaggtagtggttttacaagtgtgtacatctgtcaaaacatatcgaactgaaccatttaaacagatgtgcttcagtatatatgtaaatttttatctcactaaaattaataaaatattctccaagtgattcttgcaacattcaagtatgggaaccattgatttacactgtaatgaacaagttgctttaactttgtttggaaaccaaacaattttaatattattttaccatttaaattctgagctctttcagatagaaacttaagcagtgtgtatactgcttatcactccaaatttcacctgaaacaaattggtatatactgtttgtcataaaaataagaaaatgactttcattaaattatgctgacaatgagaatcttgtacaatttcaatgaaataactttttttaatgaaatagggtttcttttgatctcattcacattcagaagggaatttttgtaaatagaaaggactatattttattttatcctaagaaggaatttagtcagtaaaaatatgaaatagacacttgagtatacagttgaccagttattgccttgaagctactgcacctctgtaatgtatttttcatagcttatataatccgtgttaatatgctacattattaagttcaactgtgagaaatatagttgcttgaaaacagatttcttctgcatacttataaattcagtagttggaaaaaaattaaagaaatataattaaagattgcaaaatcaatttgaccctcacttaaaatgtgttgagtggaggcagcaagcagcagcctacatctgatgctgttctctccttgtttacttcacaaaactgtgcaaattagaactttaatttacagagctgttaaagcctcattaaaaactttcagcaagtatcctattttgagggtttttttccccttatatctaatatgcagcattatctctgttttgtgggcatgtatgaggcaatatctataggcatattaatgtaaactgcatatatgaaatgaaagtttttcacatggaaaggacactagtggtgtctgtcaattgcttcccaaagtgattaatttctccatttacttggtgtttattggcatctactaacactggatctctgttggatcataggaatataattgggctccagtgaaatgggagaattccctgacaccctgttgcaggatatgtgacagaggtgtggcttgtctgcttgaccgccttgcactcaaactccttgcaggagagggagcatgcagatgggcaggtgtgggagccagggcaagaacttttgggctccagtcccatggtagtatctaggggtgggtgcttgtgactcccaaagccccagtgggtgtgttacaatgcccttttagctgtgccatccacatatggcttaagtgttaaccagctcagtgctttcttggtacctgggttcttgtccggtgtccaagaagaatcaggttacatggataaactgaaggatggtaaatgtgggggattttattgctggatggaggtggctctcagtggaatggatgggaaactggaaaggggatggagtgggaagatgatcttcccctggagtttgggcatccggcggccaatctcctctctgactaaccccagccgaaatcctctcaatgttcagatgctccttttcttctcttcttctatgtggcactgctctgctattctcctgttcctctgctcttctgctcatggagcctggggtttggggtttatatgggtataggatagtggggcatggtgggccaaaaggcaacacttgggtgtgaaaacagaagtgcctttttttatttagggctgtgggtttccaggcttcagggtggggcctttgccagggaactgccctcttctacccagcatttccctgcctcctgtctttatcaccagtagacttgttccctgctcttacaggatttcatgcgtgtccgtgtgaagagaccaccaaacaggctttgtgtgagcaataaagctgtttatttcacctgggtgcaggcgggctgagtctgaaaagagagtcagtgaagggagataagggtggggccgttttataggatttgggtaggtaaaggaaaattacagtcaaagggggtttgttctctggcgggtgggagtgggggtcgcaaggtgctcagtgggcaggagtgggggtcgcaaggtgctcagtgggggtgatttttgagccaggatgagccaggaaaaggactttcacaaggtaatgtcataagttaaggcaaggaccggccatttacatttcttttgtggtggaatgtcatcagttaaggtggggcaggacatattcacttcttttgtgattctttagttacttcaggccatctgggcgtatacgtgcaggtcacaggggatgcgatggcttggcttgggctcagaggcctgacattcctgccttcttaataagaaaaataaaacaaaatagtattgaagtgttggggcggcgaaaatttttggggggtggtatggagagagaatggacgatgtttctcagggctgcttcaagtgcgattaggggcggcgtgggaacctagagtgggagagattaagctgaagggaggtcttgtggtaaggtgtgatattgtggggatgttagaagaaacatttgtcgtatagaatgattggtgatggcctggatatggttttggatgaattgagaaactaaatggaagatacaaggtccgaataaaagaaggaaaaaaatgggtattaaaggactaagaattgggaggacccaggacatccaattagagagtgcccaagggggttcagcgtaattacttgcttggttggcaagtttttgggctctatccttgagtttttttatgttgtcatacaccaggccagattgatttaggtaaaaacaacactcctcatttaagaatatgcagagtcctcctttttcagcattgagtaagtcaaggcctcggcggttttggaggacaactgcagctaaagagtcaacttgggcctggaggactgataaagtttgtgatatgtgtgtgatgctagcagagaagtcattagacaggctacagaaggtcatgacagacgttgaaatgcctgctattccagtaccgagagcaatcatggaggcagaaagtcctaaaccgaccatcaagggaattagtggaataactcttttttgtcatgtcggtgtcatgaggggaacagggagctcttcggtcccatttgcaaattgaattttgggggtaaggaagactagtgtacatgtggctgtccaattggcaggtagacacatgtaggtagaggatccacagaggaagaagagaccttgtgcgaggcaaaactggagatgtaaagtaaaaaggtgagaaggagtgctgaaaggggtgtcttgtacccagactcctagggatccacctagggcggcagctgtcagaggttgtaatggggactgatggggtaactgcgtagagggggaggttcgattttcatggtgtatgagaaaacgttgagtatctacgagcaacctttcactgttattttcggggctgggtataagtaaacaagaagagggcctgggaggagagtctgatgagcaaggggaaggtagccaaggatggagtgaaatacagggcacgtgtcttcctaagcaataattactgctaatgtttttaagtttgtcagtattgatagagggcttgtctgtaatatggagctggaaggctccaattgtttcagtgatgtgtgtagttggacttcggagatgaagagtaaaggaacatcgagaaggtgaaaggttacccaggggaattccagtgggtctttgccgagagatacataaaggagcagccacaggaatagtagtttgtgttgtgagaggtccaaatatggggggagtagagttaatataaggagaaaggttttttaaataagtgcgaaggagggcggcagcttgctgatgtgaaatgtctggggaagtcttgctgaacctgtctagaaagtaaatgagttcttcaggagggtaaaggtgagggctgttaaaggaagttcggaggtgtagggagacgggagatgttgcccagtctgtctgtaagacggggacagctgtgtaggcactggaagaaagggaaatgcaaagccagcagttgttcgctaaggagggattagaagcagctaggagagaatgggttaaggttgacagtgtggtggagatagctggggagaggtagagggtgacataagaatgggaatgagaataagagtgagtataaaagtaaagaatagaacttcatcagggtggaagtattggagggtgccttgccagcaaagatcatctatccactttaagagggagttaagagtggcagtttggggatagcaccaagagatatcagctgtgatggcttgaagaaacagtgtaaaccagcagtgtaaacaagagtagggcatttataagtagttgagaatggagaataggagtatgaccggacagaagatagtagggatgactagttttttggggctcggcctaagtggtggggtgacttcgtaaagccctgttgcaaaaagtagggtaaggacgaacagacctaatagaatgaagggatgtattaggctcataagggttattactgttcttcagaaatacgagtgagtttaagggaagtgggggagagtacttgcgacttccaggaggaagaggagggattaggctggctgtccgatggacacagctttattctggaatggtgaacccagtggggaggatcctgcaggcggacggcagtcggggtactatagatgactaagtagggtccggtccattgaggttatagagtttgaggggtcagattcttaacaagaactgatcgtccagctaggttgtcttcatatggctggggatctggagtaggcaagagaagattagcagcctggcgaatttcctgtctagcctgctagagcactggaagatagtagcctagagggctggtgtctgggatgaggttggggccaagcaagaaagtgcgtccatataaaagttcaaatggactgtaccctgtagcatctcggggacaggctctgactctgagaagagcaagaggtaaaagtactgtccaatcctttttaagttggaggctgagcttggtgaggtgtgccttttaaaagaccattagtccgttctacctttcctgaagattgaggacggtaaggggtatgaaggttccactgaataccaagagcctgagaaactgctttggtgatttggctagtaaaggctggtccgttatcagactgtatagaggtgggaaggccaaaccggggaattatgtctgacagaagggaagaaatgaccgtggtggccttctcagacccggtaggaaaggcctctacttattttgagggcctctaacagtattaaagcagcggcagccgctgcacacagacatgagggctaggttaaaacagtaaggtcaagttgtttggacagaaaggctacagggtgtggtcttggctcttgtgtaaaaattctgaccgtgctaaccatgcctaggaaggaaaggagttgttctgtagaaggtgcttgggtttgagagattagtcggacaggattggcagggagagcacgtgtgtttttatgagaattatgccgaaataggtaacagatgaggaagaaatttgggcttgattgaagtaatgggggctgtctgtgaagctttgcagcagtacagcctaggtaatttgctgagcttgatgggtgtcagggtcagtccaagtgaaagtgaagagaggctgggattaagggtgcaaaggaatagtaaagaaggcatgtttgagatctagaacacgataatgggttgtagaggcaggtattgaggataggagagtatatgggtttggcaccacagggtgtataggcaaaacaatttggttgataaggtgcagatcctgaactaacttgtaaggcttgtctggttttaggacaggtaaaatgggggaattgtaaggagagtttataggctttaaaaggccatgctgtagcaggcgggtgataacaggctttaatcctttcaaagcatgctgtgaggtgggatattggcattgagtggggtaagggtgattaggttttaatgagatggtaaggggtgcatgatcggtcaccaaggagggagtagaggtatcttatacttgtgagttaaggtggggggatagaagaggaggatgcaaaggaggctttggattgggaagaagggcggcaatgagatatagctgtagtccaggaatagtcagggaagcagataatttagttaaagtgtctcagcctaataagggaactgggcaggtggggataactaaaaaggagtgcttaaaagagtattgtctaagttggcaccagagttggggagttttaagaggtttagaagcctggccatcaatacccacaacagttatggaggcaagggaaacaggcccttgaaaagagggtaatgtggagtgggtagcctccgtattgattaagaaggggacgggcttaccttccattgtgagagttacccgaagctcggcgtccgtgatggtctagggggcttccgaggcgatcgggcagtgtcagtcttcagcccctaagccgagaagatctgggaaggagtcagagagccttgggccagagttccaggggctctgggagtggctgccaggtgagttgaacagtccgattttcagtggggtcccacacagatgggacgcggcttaggaggaatcccgggctgcgggcattccttggcccagtggccagatttccagcacgtgtagcaagctcctgggggaggaggttctggaggaatgcctggccgctgcggttcaggcgtttggaagttcttgtgtgctggagatgtggctggggtttgtctcacagtggaggcaaggaattgcaacttttttctattatggtacaccttgaaggcgaggttaattaaatcctgttgtggggtttgcgggctggaatttaatttttggagttttatttaatgtcgggagcagattgggtaataaaatgtattttgagaataagacggccttttgaccttttagggtctagggctgtaaagtgtctcagtgttgctgccaaacaagtcatgaactgggctggatttttatatttgatgaaaaacagcctaaacgctatctgatttgggataaagaaaaaggagcattaaccttgactatgcctttagctccagccacctttttaagagtaaattgctgggcaggtgggggagggctagtcacggaacgaaactgtaagccggaccaggtgtgaggaggggaggtgataaaaagattatagggtggaggagcagaggctgaggaagaattgggacctagctcggcctggcgaggaacaacctggggaggaagggagaggtcagatgggtctgtagaaaaggaagattagaaagactcagcgatgcttggggttggtactgaggggacaggcaggagggaaagaaggaagatttgggatgagtttaactggtcacagagactaggaagggactgatgtgtaaaagaatgcctggatgtcaggcacctcaggccatttgcctattttatgacaagaattatttagattttgcaggttggaaaaattcaaagtgccattttctggctatttggaactactgtcgagtttgtattggggtcaagtggcattgcagaagaaaataaggcatttaggttttaggtcaggtgtgagttgaagaggttttaagttcttaaggacacaggctaaaggagaagaaggaggaatggagggtggaaggttgcccatagtgaaggaggcaaaccctgagaaaagagagcatagagacacggaggaggggagtggggttcttgccctccagaaaagcagagagggggttgggacacggaaataagggattggggcacagagataagaggtcagggtgcggaaataagggattggggcacagagataagaggttggggtgcggaaataagcgattgggggtttcttgccccctaggaaagcgggacttgccgctaagggtgaaggagaaggggttgaggggtacttgcccctgccccaggaaagcgggacttggcgctaagggtgaaggaccaaggcaggtgtccctgcgtggtctgacacccttgaaacgtgagtgtataatcagagaggtgtccctgcaatgattaaacaccaagggaaggctgccttcccagtctgtgaccagcgccggagttttgagttcacggataaaacatgtctcttttgtctctaccagaaaatgaaaggaattgaaattaagagaagggagagattgaagtgtggcaccaagattgaaaggagaaagcggttgagggatagtgagggaggttggagaagagagtaaaaaaggccgcttaccggatttgaaattggtgagatgtttcttgggctggtcggtctgaggacctgaggtcgtaggtggatctttctcacagagcaaagagcaggaggacaggggattgatctcccaagggaggtcccccgatccgagtcacagcaccaaatttcatgcgcgtccgtgtgaagagaccaccaaacaggctttgtgtgagcaataaagctgtttatttcacctgggtgcaggtgggctgagtccgaaaagagagtcagcgaagggagataagggtggggccgttttataggatttgggtaggtaaaggaaaattacagtcaaagggggtttgttctctggcaggtaggagtgggggttgcaaggtgctcagtgggggtgctttttgagccaggatgagccaggagaaggactttcacgaggtaatgtcatcagttaaggcaaggactggccatttacacttcttttgtggtggaatgtcatcagttaaggtggggcaggacatattcacttcttttgtgattctttagttacttcaggccatctgggcgtatacgtgcaggtcacaggggatgcgatggcttggcttgggctcagaggcctgacacaggacttgtgggaatataatccatggctgtttgactactctgaactgttatactgctgtttttctgcccagggggatgttaaagccaaaagcaagtaatcaacaagattttttttaatcttaaaatactgaattaagccttaacctttaaaacaatttttgttgtagacatagatttgctatttgtttcagacatcctttaggcttttgatctagcacatgactaccccttcttaccgcattgcccctggatcccccaaggagagacacatggctacctcctttgtaccttggcccttgctgtactgatcacagctagttaggacagctatgaaagcctgctccatgcagaactgattctgttcgcatgagaatttggaattggaatttagagctaaccagttggtctgtgtttgtcctgaacataacataaaaattaattgaaatgagagacagagagaggtgtattgttgtgggggcgggtgagaaagtagggtgagggaagggaaggagggaatgctgaagtatagagcagagagcagcagagaggtgagaaacaggaaaacattcctcaaagcttctccactcccagtccaggaatcttgcctagccttgagttacagaacacactgttatctctggataatacatttcctattttgctcaaagtcctggtgtgaatatgcaaccagagatttttaacgtaaaaagaagctatgagcatatgaatggaagttgaagacctgagaatggactaagggactcagggttagggacagaccctaggaggaaagatggcattcagagatagatagttaaaaaacaatcaagaaaaagtagccagataagtaggtgaagaactgcttgacaatcaaggaaagattggtgaattaggtaatattcatttgcataaaatgttgcccagtggtcaggtaggcgaaaagctgaatataggcagttagattttaccatttttatgtttctatcccctgctacctgactaaactattttcaaaatgtattttatagcttagagccttcccaaaattcctagtattatatataaatttccaatacatattgatagctgaacaatcatattttcctggggtttattttaataatatatgcatttattttagccaatgatattcacaaagctttgctgaaatgtgttttgtttaacttggttctgtatatttttccatgaaaagccatactaaaaggacattttccaagtattaaaaaaaaaagcaaaaaaccctgcagtccagaatgcataatttgttctgggatagttaaaattctaagagaagtcttctttgttctttccttgctctttctttgttctccaaaagggtcgtatttaaactatgggtcatttctcatctgaatagccagggaagattagctacattgctactgatgcacttgatattttctcattacataacatgtggccacagattctagccagtctgataagataaaatgttcataatacttagaagataaaagggaatcatcactacttaagatccctttaaatccaatctgttgatctgtatgagattacatttttggctctcatttactagttccccctaaagaaagtcttgatatagctactgggttcctggcttgtattttgatagtcaaaacggcagtctggatatttttctactcagtagatacaatagaagaccaaagcttcttgcattgtagtcactgaccttgccatgtcatttcatattttctgtagatttggtcctggaaaatcaaatattaagcaagtttgacagttcagctaaattccataaggtcatctatcacattacatacagtaattgattttacgttaattggtctttagtttcatggttcatgtttctggttttctggtagtttccagaaactttcgtgttaaatgaagagctatgctatgtaaataaaattcagtaaaacttccctttcattttaattatgtgcttttgaaaactaattttattgggttctttaaaaaactccgtaggagtcaggcatgaattttctactctttagggcatttcaatcatgaaagaaagaaccatctatatttttcatcatctcaaaacaattttagaccactactatttgtaggtacaaataatgttcattgatttgctttatatttattaatcacctaatagttatgaaatggtgccctaagtactgtgactaaaaaataaatattagtaagttaattttactaatttttatccttaggagctttaatttatgctagataatatctgagaaaaagtcaatagtatgatgctgtttaaagaaagaaagcaactgctatcctgtgttgttgtattagcagaattgtcaaggataaaataaataaggtgaagattagactccacttggcaatctttagcccttgattggagtaccatgttccatttgggaaggcacacttattacaacatagacaagtttggcagaggtttcaaaagaaagcaacaaaaaaatgatgaagggccttgaaaatggggcctgtaagaaaaggctgagagacgtgagaatgttcaatcttgaggaaaaaaggcagaggggacacatgataactgtttacagatgcgtaaagaggtgttatggagagaagagggacctatttttctcattagtcaacaaagacacttcaagaagtaatgggtttaaaacacgtggggggaaattcaggttaattattagattaagttaggtaaaatttaaatatttaaaatgttatgattccaagcataattaggctgtggagactaaatcacattagaattggcataggaaagtgagatgaaaacaaattcaatctgaatgcagagggttaattattgcaagtttatatttgcattaaatgttatcatatttcaaaatactttcacatatattgttttactgatctctggacattcttaggaaagagagagtgtatcagctagttttacagctgagaaaatggaatttcagagaggcaaaatgttgcttcgaacccccacactccagattagatagacaaaactgctaagtgcataggattagacaagcaggactaaaagccaactcttcacattttctgtcaatatgtttcacatggtaccttgctatcttttcatttgtaatatgatttctattgtggagaaatattgtttacatagaggaacaagaaacatgattgaacttatatctgcattacctatatctattatttatctctcactactcacaattgtgaaataaactcagcactttggtattatattttgacaaatcattgccaaacgtaatacaatctccagttggtatgatgtggtgagaccctaccttctaccattacctagaggtggagacacatttcatcttttatgaatttcatattcctcatctgtaggaagaaaattataatatcttctggtttcttctagttttacaataaggagtgaatgagaaaatacctgtagaagtacctgaacttgttcaaagaaataaacttgttcaaagcataaactttgcttggggggaaatgtgtgttgtttttggtgtactgtggattttgataatccctttccagttttattttcaatcctaccttttttttttttttcatttcctaatttcagattcctgaggtcaaggccaatgtctttgttgaagcacttaaaatttgctagtctaatgtaggtgttcagtaatagttggtgggtgactgagttaacaaatggatgaataaatactttcagttggatattatgtctgggatatgagcaagaggtgataaatgccatatataatcatcttgttatactcctttatgtaatgatgtatgtttaaagtattttatagaaacatggtatgccagattctcagttagatcctgagaatacaagccactcaaagtctaaaggggttttgcagaccactccaatgctaggtatagacaaaactcttcccagcaaagcaaggtagctgatgccaaaatgttaccaaggaaagacccattggttggttgccaagacccttatggagtctgagaagatgttttagactccctcaaccatgcacacaaattgtgtaaagtaatccaggaggcagcctaaatggaaaggctgttagtatgctgagcttgctaggaaatggaggaattttacggaaaatgtcagcctctgtagactcctgtgatgctcgctagggtgccagccttccccagggagcccacagcacctggcaggcagactgcagcagggagtctcactgggaggatacaaaagagcttaatggccccctgtgcataatgttgaaagaggctgcaatttttgttttcttcggagattaacgtgtgtgtattgcaggttcaaaatggtaagaatcttaattagagttgcaggaagttgcataatatactccatgtcttactttttccgcacaccaaataacagaatctatttgccaaattatgaaggttgatggagaatgaaaactgtaatttgagtaaatgggagccctgcccccattttttccagttagtcacaaagtttaaaatgcaaagaagtaaatctcccaagggagcaattctatttcatctgtggaagaaagacatatgttgttactgatgaaacctctgttgtgaaagcagagccaatgctgggaaaaacttgaaggaaaaactagctgagagccctctgtctcaggagcctgtggcctttgggtccacccagggctgcctgtgcctcttcctgaggcttttcttgaaggcctgctctttcctctgattaccttagggcaattgcctgcctctcttaagagaaaatgtacctgttttgtgccacatcccttcaggcccctgagctggacagtagattgatctgacagatgtcactttgatattaaatcaatagtaccaatatgtttctgggttttcctggccttagcaaggttttatgttcacttacttagagacattctggagaatatctcagaactcaaaacatgagatcaaattggagttctatgggagagaggatattgaattacttggctttattatggctgcactcatagggccagccacgtgtaaaagtttcattctctttttttgaacaaatatttattgaaaacaataaattaccaagaactgtgttaaaatatacagatgtctaagcagacacggcacaatctatggccctaagaagtctaggaggtacaatattttatataaattattcatcttcattcaaagttatttattgagcatctactatgtgccgtgcactgtgcatgcccctggaaagcataagagacaaaattcctttctttgtgggagctgtattctagtgaggttcagcaggtgaacagcaatccgtgttaattatttcttcttccactgaaatgaaaattctatgtttctaaaaaatattataaaagtactcttcaaacctcatattaagaaagtcaaattgtctttagccacatttgataaggattaaagataatcttactattttattttaaacatatttagagcagtccttgtctgaaggaagcttgtgttgaattttttataaagtgagttaattaccttctaattaattttgtgtgtgtgtagtgctcacctaacacaagattttcatgctgaatttgctcccccaaaagaaaaacaattcctatatatgttgtaaagggtcgcaagtcagaactgagatggaggcaatacaaatatataaccagcggcctcagacaagttcccaaaattgggaagaatgaagagatagggaatgactgcagagcctttttcaggaaagcatgagattggaagatgaatgctcaagtaaattagaactcaggaaaagtactgaacagcaggatcatatcatcaaaaatctggctgataggttttgaactcactgaactgaatctatttagaagtacattttgggaagactaaataaacatcaacactatggtctattctaattcaggctcttgctttgtctattttccaggtgataaaacactgattgttattagtgttatcatcaagcatattgagcagtcaatctgtaagttaatagcaatacacagccatatagtcctggaactagaaggaaagaaaatgaattttttcttttttttttttctttttttttctgtagaggggaagaaaaattcaacaccttgagtcagctgcgactcaagggtccattataacttcgagatttttaacagcctgtgcctagggtatgggagatgaattttgttccaaagtggtgacatgggcagatataaacccctgggagcaatttcaggcaagttgagagtccattctaaacaaaaatggacagaatgtggaagatggaattcccacacttgctttctgaccttggctgatattcctcagcagttggtaattagaggaaatactgaagctgagaggatgaaagaataaagaagagtagaataatcagaattgaaagaatgtaaataagtaataagatggggcaaaaacaggaatggtgtcactgacaaaggtggccacactttgcagtaagatgtgagtgggacatagaaactagatttggttgagtaagaggaaaaccatatatacacacacatatatatacacacacacacacacacacacacattaatatatgcatatttaaaaatatatacatttcaaaagctcatttatgttgaatactaagtgggaaattcatcagctgtttggcttcctgtctgttttattctttgccattgcagacttgagttgtcttcctgaaatctttctgggagataactgcatgcccagcccttttctttcatcagaaaaagggtattctgccctgagtcagaagcagggggaaaatagatgataatatctacatgttattgctagaacagagtcaaataaaaattaaaagtccatcaagtgatcaggttgaagtcaataaaaaggtcaataaaaagcaaggatgagccaaaaaagaggacttggtgtactggaaaatgccaggaaaaataaaagacagaaaaaacactgtggcaagatcttctcctgtggcctcagggaagtgcatgataaaattaattgaagcttatcacccatgaaaaagggctacagttggagcaatagctgcacggactacataacagtacaggttctttagcctaagacaaagataacagatttttgttttacttttgcaagcttttttaatatactgagttaaaactctctttttttgcctttattcaactgaatgctgcattttttgagcaatactaagtgttgattggcttacttgaacagcaatttgttaagaggcctgctgtgtaccggccattatcctaaataccagtgtacaaagattagtgatgtgtctatctgctttcaaaactcttataatctgtagcaacatgagattaatttttacatatggtttatatataacaatctaattccaatacaatcatatcattctccatatctcataagaaattgttttgggacattatttaaagaaaactttatacaataaatctataaattgttagtagatttgactcctcctttagatgaaagttttcatcttgtcgtttttttaaattcaaaatatgttattttaagttgatataaaacaatcatattagcaaaatgcatccacattgaaaacttagctggatgggtaaagatcgctctattaaactgtgatgtttaatactgagtgtcaacttgattggatttaaggatacaaagtactgatcctgggtgtgtctgtgagggtgttgccaaaggagattaatatttgagtcagtgggctgagaaagccagaccgacccttaatctgggtgggcacaatcaaatcagctgccggtttggctagaatataagcaggcagaaaaaggtgaaaagagagactggcctagcctcccagcctgcatctttctcctgggctggatgctttctgcccttgaatattggactccaagttcttcagttttgggacttggactggctctccttgctcctcggtctgcaggcggcctgttgggaaccctgtgatcatgagttaataaactcttttacatgatattctcatgatagtgaataaatttcatgagatctgatgggtttatcacgggtttctgcttttgcttcctcctcatttttcacttgctgccaccacgtaagaagtgcctttcacctcccaccatgattctgaggcctccccagccatgtagtactgtaagtccaattaaatctctttttattcccagttttgggtatgtctttatcagcagcgtgaaaacaaactaatacaggcactgttccatctccaaatggtcataatttatcagttcaaaggaacgtactttgcatgccaccaaagggttttctaagaattgggtcagcaattttaagtcaaggttgttggttctgagttgtacctttgagtcagtctttcagcattttagttctcaaatctagttttctactctttccaatggggttattcatccaatagacatgggaaaatcatcctaatcaaaacaaatttatgatcatttctctctggcatgactgcatcaggtagcttaaaccatagaagtttattgtctcacaattctgaaggctagaagttcgagaaaaagatatcagcaggattgatatcttctgaggggctgtgaggaagaatctgttccatggttcacccagcttctggtggtttgctggcaatctttgatgttccttttgcagtgtcaccccattctctgccttcgttgtcacatggcattttctttgcatgcacatctgtctcttcatatggtgtttcttttataaagacaccagtcatactacagtagggcctcaccctaccccattgtgacttcattttaatttattacatctgcaaaatccctatttccaaataaggtcatattctgaggtatgagtgggttggactacagcatatgaattttggggagacataattcaatccattataatcatactgcataactgacgagaaagtaaagaatcaatctgatgcaggaaagataacctaatcaaaaagaggaattaaacaactccaactaattccttacatttaatctatttaatataaaattataattttgcaaacacagcatggtgcactatggtaactaaagcaattggatgatatttcaaaagctttaataactagtatttaatcacagatgctgtgtgtttttacctgaaattcatcctggtaatgcaacataattaattgcacaatttattttagcatgagttttcttatatttatagagatagcatagcaatcttgttttcaaatttccctcagaatgcttgagatcagacattattagcatggagacaatagtttcattgtcaactcctgctggtttgggtacatttacagtaataaccacaatccactagcttgaattattgttcaacattctatgtgacttcatgagggtattaatatgcaagagagttatttgatactaatcaaagatacacatttgtcttcacacttattacaatatggtaaggtaatcacataaaatacttaagatggtagacttcatacatatatatatatatacttttaatgaatatactaaagctaaccgttaatggaagctttgacagaaactcattgttcaatatccaagcaaatcaattttggactataaatgcagaattctaacaagcaaaaattctaatcattcattttatttttctgttattcgtggcttcttatattgttaaggcttaacatattaagatgcacataggatttaatcttcatgagagagcaatgaatacatcattgaatacataccaatcatgtgtaattgttttcatatgtatgtaagcccagcggaaaagagtcgttcattgacagtactcattttcccatttggtgtattttcctaattgtacagtataacagttatagtaaatggttataaatattaccctttagctgtaacatctatgacatttttgttgatcatgataatatgtgattgtttagtcaactgagtttattgtaattgagattggaaatcactataagagtgaaattgaatatatagatagagaaataggataagttaatatggcagctcaacactgaacacagactacaacttcttgaccaccgaaatatgcaaaatattatataatagcttgtatctggacagcgtgctaagctgttcacttgttctttatcatttaatcctcttttcaaatatgtgagatatgttctgagaagataagcaccttgttgagtcatacaggtaatacattttaaaggaggaatttatatacacttaagattgtgtgtgtgtgtgtgtgtgtgtgtatgtgtgtgtgtgagagagagagagagagagagagagagagagagtttcaggctccaagacagatattaatggtagactgcctttgttgcataactgtagcagtggtgtacaactgctactcccatcttctcagtacttcatctctttctttgaatcaactacagctattctgatggctagattatgatctgccagtttgagaatccaactcttgctggccagagacttacagttaaaaaataaatcatttagagtcatatgcttatgtactactgggctgtgatcctcaccctaaagctcactttggcatagctctttacttgccatcgattcttgacagccttatttcagaattcttacagacacagtgtctatttaattttaatacaatcaagcaatggtttctggacatatttggctatttctttgaaaacaatggaatctgtcttatgggcaaaatgacttttttctgccctaaatgctgacactgaattgcgttcaatcatgacagaatttgtgcaatatgaaaagtttgtccactgggtggacaatttctatctagcatttttctctccttcagggatggactttaagttgatttgacaaaattggtttcatatgaacccaaatgcaaaccctatattatctttaaacactggtttctgtgaagttgtttgattaaactaatactgttgactccctgttttctgttttatttctttaagatgacatcccttattctgttctgctacctgggacattgctcttctctccatattaattaattaatattgtttcctaaatctgtcttcctagtctctgtgtttgtcttcaccatgtgtattgggatatattctcgaagggtttcatgtgtgaattccctcttgagtcaaattgtacatgtaatttcccttcattttaaaaataaataagaaatatgagaagaattttcaaaacttttatgttctatatgctttcctctggtttggaaattaatctctgaatttatttatattttaggtattgcaatttgagaattagaagagttgtttttacaaaacacagaaaacagcttttgttttaattatttttcccagtgtgtctaagagtcaaaaagactctgtattagtattcactggcaaacagaacacaatgcagagcagatatcctagaagcaacatgatagatccaatcatccgattcattatagtacaaatattgtaatcaatcataatattcagtgttccataaatccacaattctgtgaaagggataagaaaaaagaaattaagctatcagtgagtttactaaaaaaggaaaagagatttcctgattatcatcattcagaattagtcagacatatacatggtaatcattcatattttaagcaataaaaggaaactcaacacaaagcctggaaagcaacagccttttatttttattttctctaagatgtgaaaaaatagacctaggtgctaatttaattcccttttaagttaatgacataatgggtttgtggagcattaaatagggaataaatatggccttacatttccatgtcggagctaaatgctttctcttccctcagcttctaattcctcagctgagggaagtgatcagcagtcaacgatcacaatgagggagctacgcacacatcctctggtttcctgagctttggaacacttaatgcttagtgcagcttctctattttgagttctaccatgaacccctctctgatgactcccacatatgtcttttttatgtaagcacaccaagttcagctatccctgtaggtagacagcatttgagacttctcagttgggtatgatttgagaagataatggagctgatcctcttgacataaactagcctattggtcctgcccaaactggtgttccctggaacagaggcctaaaaacaaaatatatttaaaatgttcaaatatatttagaaaatattgtgttaaatcaagttagccagatttttgttgctttcattgtcatttttgttaatattgttgcatgatttccagaatattcagtatgcaaataaatattcattatgaatttaacaaaataggtattttctaaacttctttgaccttggaactcttgttctcccttcccaaccccaccattgcacttattttaacattgcactcagcagggctatacgcatcaacattttgggaatttgaggatgaagatatgtttttcctattaaaaatgaattcttatcccactgggaaagaaaacacattaagcttttatcagtctttaacattttaacatggattagccattctgctctttctggattataagcagctgagagcaggctttcattatagggagagggaaagatgatctgaagtgtcatgtgtccccagagaggattttcaagtggaatgccaccatgagagttcctgggctagcagaggacaacttcatatagtgcagggttgcagcaaggccactgacaccagctgtatatagaaagttatgtttgcctcagtttcttcagccaaaacagaggaaatttactagatagtagctatctccctcttagctctaacaatacaatctgattatcttgatggctaagtgtgggaactgagagagttagaagagtgggggtcactagttgaaaaagcaaggttagaaatgaatgttttctcagtcatggctggcctagggctggctctgcaggagttcatgattctcatctccccaaacaacaaagagccatggaaaattcatcagataacagtaattcaacagataacagtataaagactatacatatttttaagatagatttaaaaaatgcatgacatatttctggcctccaatgagtgttcagtatgaaaaaataccaactagatgaataagtataggcaagcaaaagattctaagtataagaaagtgtgaaaagtaaaatttattttatttttctttgaaagagcagtcttcccaggtcaagagattagaaagacaagtaaggtaatgcctcttctctgaagtttagaacagatgaaagtgacacataaaagcagaataagataaatattatatcatagtaaaaggaatgagaggttgtatgtagagtggttgtggacttggactcaagagcatgtggacacaaatttctaggttaaattccctggattcagaacccatttctaccatcttactaggtctgtgtcctcttgtgtaaatggtagtggtgatgataattaccatgcctttctgctagaactattattaggaggattaaagaaaattaatatgtataaagcatctagaagagtgcctcacataaaataacaaacataagtatttactatcattaataataaattatatccaactagaatcattataaggggttttagaaaagaagtagcaataagataataagtgaagaatgagtaaatttttgaagctacaaatggattgaacatagtactctagggagagggacaatcatgaatgaatacatcaagatgaaaagtcaaagggtaaattttagaaatagcaaatagattggtttgctaatataacatactggccctttactgatcatgttgatcattttgtgagaaaacagtaggaaatgacttcagaaagaatatagtttggtaaaaaccattttaactgtaggagaatgaaactggattctcatctctcaccttatacaaatatcaactcaagatggatcaaggacttaaatcaaagatctgaactaaaaattctagaagataacattggaaaaacccttctaggcattggtttaggcaaggatttcatgaccaagagctcagaagcaaatgcagtaaaaacaaagataaatagatggaacttaaccaaactaaagagcttttgcacagcaaaaggaatagccagcagaacaaacagaaaacccacagagtgggataaaatcttcaaaatctatccatctgacaaaggactaatatccagaacctacaacaaagtcaaacaaattagcaagaaaaaaatgaacaatcccatcaaaaagtgggctaaggacataaatagacagatctcaaaagaggatatacagtggccaacagacatattaaaaacatgctcaacatcgctaatgatagagaaatgcaaatcaaaaccacgacacagtaccaccttactcctgcaagaatggccataatcaaaaaaataaaaaaataatagatgttgaagtcgatgaggtgaacagggagcatttcttcaccgctagtgagaatgtaaactagtacaaccactatggaaaacagtgtggagattccttacagaactaaaactaccattagatccaggaatctcactcctgggcatctacccagaggaaaagaagttattatatgaaaaagatacttgcacacacatgtttatagcggcacaaatcacaattgcaaaaatatggaatcaacccaaatgcccttcaatcaatgtgtggaaaaagaaaccactgtatatatatatacgtgatatatattgcatatatatatgtgtgtatatgtatagtatagatatatgtatatatatagtatatatacacatgatatataatgtgtattatatattatatattatatataatatatataaatatatattttatatatataaatatatatgatggaatactactcagccatacaaaggaattagttaatagcattcacagtgacctggatgagattggagattattatcctaagtgaagcaactcaggaatggaaaaccaaacatcatatatgctcactcaaaagtgggagctaagttatgataatgcaaaggcataagaataacacaatggactttggtgactcagggggaaagggtgggaaggcagtgagggataaaagactacaaatagggtacagtttatactgcttgggtgatgggtgcaccaaaatttcacaaatcaccactaaagaacttactcatgtaaccaaacaccacctgtgcccagtaacccgtggaaataaaaaataaaagaaatttttgcccaaaccaatgtcctggagtgtttctccagtgttttcttctagtagtttcatactttctggtcttacatttgagtctttaacctatttaaatttgatttttgtttatggcaagagatagcattctagttttattcttctgcatatgtatatccagttttcccagcatcatttattaatgagactgtattctccctaaggtatgttgttcacacttttgtcaaaactgcattggctgtaaatatgcagatttatttctgggttctttattctgttcttttggtctatgtgtctgtttttatgccagtaccatgttgttttggttactatagctgtgtagtataatttgaagtcaggtaatgtgatgcttccagctttgttattttttgctcaggatgtcttggactgttctaggtctttcgtggttccatatacattttaggattttttttcgatttttataaagaacttcattagtatttcgatagggattgcattgaatctataaattactttgggtagtatggacattttagcagttactgattcttttaatacatgaacatagaaaatgtttttatttttcatatctttttcaatttctttcatcaatgttgtattgtttttattttagagatttttcacttctttagtttattccaggtattttattttatttgtggcgattacaaatgggattactttaattatttctttttcagattgtttgctgttagcatacagaaatgctactgatttgagggaaactcttctacactgttggtgggaatgcaaattagtatagccgctacgaagaacagtgcagaagttccttaaaaaagcaaaaacagaatggccatatgacccagcaatcccactgctgggtatttatccaaaagaaaaacatcagtatatcaaagagatatttacactctcatgtttatttcaacactagtcataatagccaagatatggagtcaaactaagtgtccatcaatggatgaatgaataaagaaaatgtggtacatattcatgatgaaatattcagccattaaaaaagaataaaatccagtcgtttgcagcagcttggatagaactgaaggacattatgttaagtgaaataagctaggcacagaaagacacatattgcatgttctccctcataggtgagaactaaaaaaattgatctcatggagacagagagtataatgatagttatcagagcctggggaaggaaatggggagggggataaagaagtgttcggtaatgggtaatgggaacggaagtacaattagatagaaggaataggatctaatgtttggtaacaaaatagtgtgactataattaacaataatttattgtatatttgaaaataactagaagagtggaattggagtgttcccaacacaaagaaatgatgcttgcttggggtgatgcatatcccaattatcctgatttgatcattatacattgtatgcatttgtcaaaatttcacgtgtggcccataaatatctacaactattaagtaaccatgaaaattaaaaattttacaatttaagaaaagttaacttgacgagaaaaagaatacagtttggaagtcttcgaggatagataggaagagattttccatttaatttggttttaaatgggatcttgtctatgtttgctcagggtaatcatatgaaaggcattataatttgaaagcttaatctcaaaatagtactttttttggtaaccagttgtcttgcagcaaaaacaaaagcactgaacttgggtcaaaatacgtgaattcaaatccatactttataccttcagaatcaaacactctaagcctcattgcgttactctttaaaataaggaaagtgcatctaaattacacattgtttttagtagcaaataagttagatgaaaaagcatcaaatgtaatgttgggcatacataaattttcaatcaacttttaactatataatattatctgaacaagacaagtgaagaatacaattgtaattttttaaattgcaaggcaacagtttctaccctaataatatctacattttcctcataaaagtcagtgcatcagattctatacagtatgctcttcaaattcttggctccaaagttagcaaattaaacatcccatctcatttctagtttgcagtgaaattctcaaaaagtttccagaatccctgatgttactcatcctgagctacatctgacttctaatcagcatcttttacttagaatacagatagcaaatctggttggcagttattttccaatgattcttctgccatactgatgctttataatggctccaaggaaaggccattctacaaataaaagcaaaattaataaaagaatgcgggataattgacagttttgctacaacagcatttaatttgaatcctttgaaacttactcttcactcattgatttttaggctcacaaattctttgtgtgaattctctcttttacttttgcattgtgaaatgatttatcatttgggtaattttccagaattacactttattattttgtaaatggcatgcagcacagatggatattagcaaggtctctgtataaacgccagcaatagaggtggtaacattgccctgagagttttctcctgaaacaaatcaaataaagaagagaaagcattgccaaagctggccatgacagaggaagtggatccaataatagacatctcgatggatacatatatatgattcaatattgtgtgacctttactttcaaactcactttcagaaaatatattctaaaggggtgccaaggatattgctgtctactctctactgacttccatgaaaggaaacaccattcctctgtatctcagtcatcaatgagtacatttatgaaagagtttggccattgtcaattctaatgccgttaagaagaacttgagcatagcttacatttttttcctcattttactcctacttgtatattgctttggcatatactattagtgcaatgctgtgacttccaaaacttctcagaaagtaacaacttggactgttaagagactccagcatttgaaatatattttaatgcaaactgtctccctgaagacctctatccatagctaagatagttgtatccgaaagctttgcgcttacttctttgcagtgctatttgtaaacattggcatagtaagagtgataaatttctatggaatcatctttatcaaacatacattatagaagtagaacttattccagctaaccacattatcatgaatagcattttccatatttctttgaaacaatacaatagaaacaatattatcttaaacattaagtatccccattgattggtccagtgaaatactgcttggaatgaaggcttcaactttaaatctatttaatcaaatttggtaaaacaatcatggatcaaatatattattaatgttacgtggcttttattattattattattattgcaaaaattaggagccttggtttttgtggccttattctatttcagttagatataatatctcctggccttgggtgctttttacatacaaatggggtaaaatagttattataaagaatagagattgaatagatgtgcttagagtaatgtctgacacaaagcaagcactcggcccagcacagtggctcatgcctgtaatcccagcactttgggaggccaaggcaggcagatcacgaggtcaggagttcaagaccagcctggccagcatggtgaaatgctgtctctactaaaaatacaaaaaattagccaggcatagtgccatgcacctgtaatcccagttacccgggaggctgatacaggaaaattgcttgaacttgggaggtggaggtagcactgagctgagatcccgccattgcactccaacctgggtgacagagcaagacctcatctcaaaaaaaacaaaaacaaaacaacaacaacaaaaaaagcaacggctgttaattgccaggaagaagagctcctacaattgtttcatgtgcatttaggcactctcttccatgtgagaccccaagcagtcagcaggactatcaaaggaacccttttaagacttagatatctatttttaattcttgcactgcatttctactttgataaggggaaaaggcattaaaacacatttttgaaatgtaaatttccaaagttacaaaaattaacccaacacatcatatgctctttgaatcacttaaattggcagctgtcttataatgataaaagacctacggcgttcttagatgatgtctacatgatgccagacagctaattgaattaaggaattaaggaagatatcaactagtccttccccttatttgccagatgaagaaatggaggccaagaaatgtgtagtgatttatttacatcaggggttgagtctgttggtcgtgagaacttctagcctagttattttttccaccccatctatctgtcctgaaatttggtttcttattgctgcagcattgaagagatggaaccactaaaaaaatactgataaaaagatgtttatccagaggcaactttaatggcaactcaaactatttgaaatatgatggaaaatttgttactgagtgaaaaggccatcgcacaatcaaaattgatgtttaaagctcgcctactaactcttccacactatccaatgtagtggtcctccttcattttgctctttagagtttccctaattttctttatgcatgcatctgatttcatcttactttagagaaaatactaacagtgtatgtctagaacatggcagattggagccttatagcacgagaggcagggaaaagacagctaatagcgattcactgataggagaagaaggggtcccatattgtttgagttttagataacgtttaatgatcttcctggataacagattctatgaggattttttttttttgcttgtttaaataaaagctgattcaatgataacaaaaggagagacagtaacttcagaaaaatatagatatgctaattcttacatttgtagagcccttttgatattaaggttcaagatctaaaaatgtaattctcattcaagaccgtataaaaattgttagttctatataagcatattgaatcactgatagattaaagcacattcatcatactctagaaaacaaggaaatgtgtaatatatttgatgtcatttttattacaattgttaaaatagtgaagaataaacctgttaactagaaatctatgcatgcagaatgtcttattacctaaataacaccagataaatgaggtgttactgtccacagtctcacaacagagacatgaaaaacccttctttacactggtaacccttaattaaactgaatttttggtgtgtcccttcaggagaaggtcaccatatcagcaataattaggggaaatggcattgtgaacattactggatgagatgtggtgtatttcttactttcaattattgcctccttgtttgaatcattagcatttggcagatttgttgctgaatttgttgttctgatttaaaactcggtgtaaggttgaatatgttcttatcttgatcttatatttctgccatgacttgcatttcttgctgagtttctgacttgaattgctctatgtttttgctgagcttttgctttgtcttgttgtatttctatctggaggggtttccctccgcctttttctttttgttatatctcttctttggcctattgtatttctctggcccattcattagctttttttttcctttaaagttattctcttgttcagtatatgcagtacctaatcaatacgcttccttgcttgctgcaggatttccaacttactgtgttttctgtcagctttgatactgcctgagaggggtttctgtgctttggctaatatattgttgtctgaattcgcagtgttttcagctcattacactgactttaattttgatgtatttgtattttatccagttcaagtcatgtttctttcctctgtcaatttaattactttctgcctgggcaacattgtgtttatacaattgctgctaaagcgacaaaaggtttctatttaaattaccacccagagcatcagcaattcagcctaaaaaatatgcagaactcctctgattgatgtcttacctttctgtggataaggaaatctagtctattgagaggatcttctttatagaacatagtcaagcctggtttatagctgtagagtcattaacagaggagatgagtgtagggctatggggtcactgtatgacttctctgtaagaaaaaaatgtatgactaggttctattcagtacaagtcatgtcctaacagcaggaaaaagaaaactttcttaggtgtttaacttatatttaggtgggctacccaagctccagctcttatttttctatgtgttatatatattatacacatttctgggtttgaatcttgttctttctaataattttgcattgggctgtgtaagtcaggaacattgaatttccattgtgtacataaaactatagcaactggtctaaaaacaaataatgtgggaaacatagtaactgttcctgttttcaaaggcttacaataatgcgaaaaaaagggaaaagcttatgagcaatacatctttgaaaacagaaacagtgaaaacactccagtaaatacataattggttattaatagaattttaaattggagaggcataacaattgcaacagctcttggaaatgcttaggaaactgaggcttataggtttacccgaacatatgtcatagataacattaatcaactagctgatgaacatgaccagcaaatgcattgattgcctgatcagcaaatgcttcaactgttttgttttacaagacttaatatgtttaaacaacaacttactctttacctactttttaaaaatatccttctgtattttctgcaacaaaccattgttgagtccctgtgcttaacaaaactgtgcaactgtgctatttacccagaggaagaagaaagatttttttaagtcagttcttttctggtaagtgtaacttttctagtattggataatctttctgagcctcagttttcttatctgtataattggcataaatgaaccatgagaaacaaataaaatgacatattcagctcagtgtgtgtcacatggtgagagacccattaagtttgctcttttccttttgcctttctcttttcagtgttcagtcattatactgtcaaataaattggagtttctggcttttctcacactcaagattattatgatatactacactagtacatctgaccttgataaaaagcaattttctatagtttaattgtatagcaataggatgggaaagtctctgattctcactctgtagcttcttcttcccagggctggagtcatttaatctctacctttaggctcattctaccctggtcccttgggtcatgaattcatctggaagattcagacttatgctttaaggctctcagaaactcaatcttgcagaagaatctggcctccattttgtacacactttgttcaaagagcctcctagcaccttcccaagacccacatataccactcccattttctctcttggttctggtgattgactctctttatgttcttggaaagctgcctagtatcctaaaaccagtattgctgcctggctgttaccaggctgcaccctcgactaaagttgatcccctgcactcatctttggactctagatttctattacatgcacatcccttgtgccaaattatgctggcttgtctggccttccaagtttcacctattgttatgcttatttgtcagttcaagtctctattccagctctatcccacttccttctttctttagcctgtgtccctctcttggatccctgaaacattttgagtactagctactcctatgtcctgcccatgtgattaagaatgatacttttctcccgtgcttgcagctgggtagtcatactccatacccacccaggtaaaaatgtctggatccaaatctacctttcataacagatctgatgtgctattctagacagctttactccatgatatattgcagactttatgtaggttaacaaagcattatggtgtcattcttgtgacagccctacattttcattatgatttttgtgtttgcggtcctttttgtgacaatttcttttagatgaaaatgcttttaatgaagcccttttggtacttgggagcctcactggaatggatttagtacaaacttgccttatttcaaatttatgttcaatattgaacaacactgttacccatatttaggacagtagacaggtaaaggttgcagaatttttatgaaatataaagcaatatccactgttataatgaagcactacataaaattgtataatacgtgagtttcttattcctcaaatagtctaactgattgttcattgggctcactcagccaaaagtagagggaaactttgtacagacatcattagtttttctccatttagagattaatcatgaagagctctggctctttaattctgtaatttgtatatttaatgggctgctgcagaatctatgacagtaattagcatagcctgaaaactcattaatacgcaacaacatgattaatgcagcattaatgcaaacatgactgaagttatttgggttatgtagtaagaagattaaagctaaaatgtcctgtttgttttaccagtggtgagtataatagagtggcaaaaaaataaaataaaaacaggtatcaaattagctgtttaaaaaaaagaaaaaaaccagcaaaatttaaatcaaggtgattttatttttcccttaggtctaaaatttgggatataagttatgttctttacttttatatttattcatttattcataaatttatcattactgaaggaaagttcattcaaccttttagtttaacatagttaaccttttagcagctttaacataatattattagtcttacattggaaacaattttaaattgtactaatctttgaccaatacattacacatttctgttttgaaactaatatatattattggctatgccaaataattaaaggatttgttcctacttattcagaagttacatattatgccctcttctcactgtgttcacctcttaaataaatgttcaaatactttataaaatactaccataaaactcatttttttaaacaaaactatcaaatatgacatgttaaatactgaaataatcaataatgtttggggatgtaaaagtatataagttttgcttgttcttgctgtctcatgtaatcatattgaagtcctctcattcttacttttttttggcttttcttttttgagacggagtctcactgtgtcgcccagactgcagtgcagtggcgccatctcggctcactgcaatctccacctcccgggttcaagcgattctcctgctcagcttcctgagtagttgggactacaggtgcccgccaccatgcccggctaatttttgtatttttagtggagacgaggccgggtgcggtggctcgcccttgtggtcctagcactttgggaggccgaggcgggtggatcatgaggtcaggagttcgagaccagcctggccaagatggtgaaaccccgtctctgctaacaatgcaagagattagctgggcgctgtggcgggagcctgtagtcccagctactcgggaggctgaggcaggagaatggcgtgaacccgggaggcggagcttgcagtgagctgagatcgcgccattgcactccagcctgggtgacagagcgagactccatcgctaaataaataaataaatacataaataatacagacggggtttcaccgtgttggccaggctggcctcaatctcctgacctcagatgatccatccaccttggcctcccaaagtgatgggattacaggcgtgagccacagtgcccagccattttttttttttttttttttttttttttttttgctatttagtatgacctgttttaatagcggtcctaaactttaaatgacttatttttcaatcttatagtcaaatgtcaagagtcattaatagtatctcaaacaaaacttgcattttaaggttaagcaatcctggatgactgaaaaaaatatgtatctgcttttttgtacttattttattctaaatccacattagaaaaatgtttatgattttattctttttcaataaaaaaaaacaagtgaatatccacgaagtacctgactcttggctaggtgttgaggaggaaaagcaaacccatcaatgtctgtgcacttggaaataaccatctgggagaagagaagctcctttcaacctagggatgtctatagataagaatgaaattgcaccatagaaagaaagcatatcaacattgcctgctaccaacagatggcactgttaatggtttgtatcacaactgtatttgtgggaccaatagatttgctaacattctcagaaggtagtctggaaggagaagagcctctgttaaggcagtgaaatgatatacatgctcaattttgtttaattatcttgtcaaaattcctggaaaaaaataaaaaaatatatttatatgggatatttcgtttaattaaaatacatcatcttttaccaaaattaatatatgtgaaattaaattgtagtagaactttaaaacaacatagagttcctattgctttgaataattggtctttacatttagtattatattatatgttatattgttatgtataccatatatataatgttatattatatactgtaatattagagtagcaactgatactcacaaagctaaacaactcagttccactgaaatataccagattttgacttagttttaaaagggaggacctagaaacagagagaaaatgcatcagtgggtaaaatcatttacctctaatgttttatttcacctctatggtttttagtgtactagagagctgtttaatcagaccattaccaaattgaataaatggctacttagtgattactgaactatttagtgatggggttggggagaactccttttttaaaaataagccttttgaatagttcatataagaccatcctaataaataaaatggaacagaatgtgtttgccatgtaatagcttagtgatttttaatttctgtattgtgatgaaacaaccagcttttctagaatgtagccagtcctttgtttctcagaagctgtgcacacttgcggcattcagtcctagtgctgccataacagagtttctaaacactagttcagaaatgagacatttttgtttagtctctgtttgggcacagccaagagtttaagactgtacatggagagaaacttgcttttttctgtggatgtaatccaggggacctgttgaggtctttaatgggtggctgacaggatgaactgggcattcaatattaaagggtggtatcatagcaagggggttaccccagcagagtttgtagatcaggaattgtttagagcctagatcttgggaaagtgaacaagaagcatgttaactaaagataaaaaacagaaaccaggtattgtctttttaaactctgagctcttggagtggcgatcatgtcttttccatattagtatctccagtgatgagcattgtctgttggagacactcaatatacatttcttgaatagagtaaggatttactggactttgacacagaactaaggttctgtgtgatagaggtctgtgtgcttatgagaagctggactgtgtaggtgaggatgctaaggctcctgttcccatagagaagtccttgagatggctcaagctgctggttcccttttttcttggactttgcaggtattcaaggtgtctctagttagaagctttatgttttgtaatgggtaaaaatagtgctaaaatatatagctctttgctatttataccaaattgagggtctctcagaacaaatacagtggacggattttaataataatagctaatacttatatagggccaaatagttctgagtacttttcatgtatttaactcatttaatcctcccaaaagacttgtgaaagaagaaactctcgttgcccacttctagaggaggatattaggtgtagaaaagttaaacgatttgtccaaagttacatataaattaagtgcagaagctagtttttgaaagcttggctctagcatttgttttttaatcattaagccaaacatcaaattccccttcccacactttttttttcacttttaccaaagaaatatcttaacaaaatgactcctttggaggaggaatacatgcatatatatatctgtgtatacatgcatatatatatctatatatgtgtatacatgcatatatatatctgtgtgtgtatatatatatctgtgtatatatatatacatatatatatgtgtgtctgtgtgtgtatgtgtgtctgtgtttctgtgtgtatatgaggtcagagtgagggccaagaagctattttttctctaaagtggttcatatattgcaagtgatttaattgagggaagatatagttgtattagctaaaacacttaaaagtttataaataggtgtgtctacacaaaggcaaacattcctctaatttctaaacagtttttacttctattgaattgaatatgcctaatattttagtgtcctgatgattaaagtatgaggaatgaattaataaccaggttcaaatatgtgtattgttaccatgcagatctgttaatacttattaattcccacatcagtgtgaactaaggaaaatgaaattaagttgcattaagaatgtgctcagttatatataaagatttacttcctgtaagagtgattatataattatatggtttactaaaatagttatgagattttattctttcattcatttgacatgcattattggaatcttagtattttcaaactacgtatttggagataaatattgcagtctgaccataatgatagtttaggtattccttggcctggaaggaggacactagttcattttattaacatgttctttgtctgtggagagcctccacaatgccattttagtaaaatactggatctttactaaaccatggctaccaaagacaaagtgtcattctaggcagccaacagacttcttgccctactcctgacaagcaaaataaaatagcctggggtaagagaggtaatggccatgagttaagtcattttcatagttatgctaaatcagcttccctcaggagcacccccttcctttcctttctctgtttaaatgaggtggagtatgatgtgactattccagcacactcaaaattagatgtgtgatcaagtattgatcttcaggaagttcctaatcctgtctgatgttttctgtgttagctttttttttccttctgtcataatgttagattagccagcaccttcattttgttattcccttactttttaaggcaggattcttctgtacaagaaccctgaagcgaccctaatattgtatccaaaatgtagggtcagaatcaggagtggagactgtgagttcattgtgagttaacagtctattatttaaaagtgcaacaagaaaaatagttttgctttcattccatttctgggactctaattttttccaagggagtctggcataaagtatcgtattggtccaattgcttgggatccactgagattgttactagagagggctttggtgtaaaaccccagagtaaaattctttaatgtccttttgggtcattgaacactttctaccattatgcttgacatggacaccattgaaatcattccaaggtcaaggtcactcagcaattttactaatgcttcaagttagtggaattttatttttccccccataatgcttgttttacaaaataaaatacagtatattttagtagatattgtaagatcaatttttgaaatttcttttatcaaaataaatataaattttatgaagtatctgtatgtttattatatgtaaacgtgcaattacaaatatgaaatataatttatatacatgtatctatgcatgcacctggatcttatttgaggtataaaacatgaaactagaactaatgtgttttacaaatatacgtaaaaagttattatttttttaattttatagaaacacagagtaagtaatgataaaaattcatttgtattaaaaatatttttataactacaattagtactaacattttgctttagcctaagcttaaatgctttatttgctagagtcacttgttaaaatactaaaaattttacaaggtatgaaggtaaaatagaaattatttcaaaaaaacaaaaatgcatgctgaattttctcttttcctttataaaacaagcaagtcctttatgtagatttctacaattcataattcaatgtcattaaatggcattcaatttatattttagactattatgatttcaatttgagacacaattgttttccaaatgaattcaatgtggggtatatttatgtaatagatgaaatgtatttcatctattttggaattgaataaattcaatttattcaattgtttggaattgaataaatacagtacgtataaagggaggatgaaaatgtacaactattggatgttgatagaagcattctgaataagaagcatttttacaataaactcaagtatatttttataatgtactttttaataatacactgattttaaaagtcttttttataatgtactttcatatattttttcttgagaaatcttgatcttgtattgacaattgcataaatatatttgtgcccagcacaatggcttacgcctgtaatcctagcactttgggaagctgaagagggagaattgcttagtccaggagttctagaccagcctgggcactgtggtgagaccctgtttctacaaaaaagtcttttaaaaattagctgggtgtgatggcacatgcttgtagtcccagctactcaggaggctgaggtgggagaattgctgaggattgtttgagttcaggaggtcaatgatgcagtgagctatgatcacgccactacactcaagccttacaacagagaaagaccttgtctcaaacaaaacaaaacaaaacaaaacaaaacaaaacaaaaataaataaatatcttggtatgtaagggcaatttggggttgataatttggagagggatggaaagatacatagatgcctatatctacatagatagagctctctctatacatacggatacagatataaatagatatctatatgcagatagatatatatctatgaaaatacacatctaaataaccatagatatctattaatatctatgtatctgtatctatctatacattttaacttaaaactttatatacacataagcctatagttctatatttgtagctaagtttaaaaagctattcaagggaagccctgagttgttcttttatggcatctggtggcatttcatatttgacgtgttggttgctattggtgtttgcactggtgaatccttccactggaaatttcatttcttcagggtttaccaatcacctaaaatgttttctttctggataatatcccctgactgctttcttcctcttttagcctaaagtttcctaaaaatttaaaatgcattgtagtcagctttacttacctttcacagaatagcaactcaagaagtgtatgctaagaggaggaataaaattatgtaaaaaatgaactagaaacatagttacctaagacaaaaataataagtggacaaaccaagagtaaacattttacttaagggtttaaaaatgatatcaatttttactagttagggacaatgaataatgcttatcacctccactgttatttagtgttgttctggatgatataacccatgtgtaatgacagaaaaaagaattatggctgttgaaaaggaatagatgaaatttccagaaaataagtttatacctaaaaaagccatcaaaacctattataaataacagaagtacaataagatggttagctataaataaatacataaaaataaatattttttccataattcagcaataacaaatctgaaaatgatctgattcttaatatcaattaaatatataataagtactatagcttaacaagaaatgtgcaggatctatttaaggaaaagagaaaagaagaacttataataatcattttaatacaaaagagtgaattagttgataggtagctaaaagcagaattttaaaaatttactaaaaaaagcaattttgtaagtaaatttgtaagtaagaaagaaaactggaatatatccctatctcactttacatgtcaaaataaattacaaattttatatttaatactttattttttccagaaaattaaatataaaaatacagaaaatgaacagaaaaaatataagtaagttacaaattctgggctaggaagcccaattataaaaagcaaaggaagacgccattattgaaaacatttagattttaaaacaaaaataaaccccctttttacatttaaaaataacatttaaaagtcaattgttaaaaaaaagtaaatgactttaacaagtgacagacaaagaaaccatacccttaatgtggaaaaaacgcttacagatcaataataaggatgcacaaatgacaaaaaagtatccaaatgaagaactacgatgaaagttcaaaatcactattcatcttgtaaatacaaattaaaactagaataagatttcattttaaatctatcgaatactagttggcgtctttcagaaatgccaggccaaactattcctgatgctagaaatgttttgcctgacagtggctgaaaactatttataacatatggaaaggaaattacacaacttgagaaatttcttgcagtgaactcagaaatgaaaaggcggttagatgacaatttcagttcattaatttataaattcacatgctaccacagattttagagatcatgcaattcagtatctccatttaagagtaggaatctatgggctattctgctcaggaaatcagcactatagcatgtatatgtatttcataaagtatctggtggatattactttcttgttttgtttttttttttttttttttatcatttggaggttgtaaagcatgatcagtccttataagggtcacatttagacagctacagattttaatcgttccaaggaaggaatgggggattatttcaaaagacgaaagaaaacattctttgatctaaaagcagaaccaccatttgacccagcaatcccattactgggtatatacccagaagaatataaatcattctaccctaaggacacatgctcgcgggtgttcattgcagcactatttacaatagcaaagacatagaatcaacctaaatgcccatcaatgacagactagataaagaaaatgtggtacatatacagcatgagataccatgcaaacatgaaaaaaaacaagatcatgtcttttgcaggaacatagagctggaggccattaccgttagcaaactaatgcaggaacagaaatctaaatactgcacattctcacttataagtgggagttaaataatgagaactcatgaacacaaaggaacaacagacactggggtctatctgagggtgaagggaggcagaagggagaggagcagaaaagataattattgggtattaggcttaattcttgtataatgaaatcatctgttcattgaacccccgtgacacaaattcatgtatgtaacaaaccttcacatgtaccccacaacctaaaataaaagtttttataaaacacatttctttgttttatacagaccagaatgaaatcatttctcaacacttcttttacattaaagcacattattcttgtttttttcctcaggtattgccctactttttaatcctaatctatagttccattgtaatttttagaatgctaatctaatatttattgaattcttttgtagtaagcaactgaaaaaaatttaattttcaaaaggaagaaaaaatacatgtttaaataataagataacacaactttggtattctaaggaatgtttggggattcattccagggcgctcatattttcaggttagctttcaactgttattttgtcgagtataatcaatggagattttgttattcatgtatttatagagctggttagccataaatagtttatgaatggagacatttctagcaccacctaatggcagtcaagtaaaaagaaaaagtttttctaatttaggaactgttttgcataatttaaattaaactatatagccagagttacttccatatgaaaatgaacttttacattccctaatgcactaactaggcatggaaatccatctctgagcaattggattgagtaggaatgaagctgaagggatatttgataatgaaaccaaggggtttctgctgtctttatgtgtgcaagaataagaaaatacctagctaatagaataaattaattttatgtgaaaattttctttttagtttcagaagcctatgcatactagattttccatactgtagtttcctgaaaaaagtatattttgagtattgtattggcatattttatttgtcttgtttttcagcagttatttatacatctttgaccaatttattctactagtttaataaagcgttttttaaagtttctgatagtttttttaaactgagtcatatcattctgattataatattggaattttctgttgaatatgagtcaaagaacatgctttagatccgtaagctctactcatttatttcatgtgtttcctagcaggatttgaagaatgtgttgtctgtcataaccctaggattgagatcaatggatttggttaatgtatccgaaggagaaggagaacttagcgatagcagcagattctgacacctttcatcctcgtctcaacactttggtttgatactttcttctatgatataaacagggaatactaggcagactgcagatacaggtagttttttgtttgtttatttgtttgtttgtttttgagatggagtctcactcagtcacccaggctagagtgcagtggcacgatctcggctcactgcaacctccaacctccgcctccaggattcaagtgtttaccttgccgcaacctcctgagtagctgggattacaagtgtgccaacgagcccaactaatttttgtatttttggtagagatggggtttcaccatgttggctaggctagtctcaaactcctgacctaaagtgatccgcttgccttgacctcccaaagtgctgggattacaggcgtgagccaccatgcccggccagatacaggtagttataaaaatcaacaagaaagagacagtctggtggtggtagtagtttcaagaaagtgctttctcttcgactgcaatttcttcctttctatgaacatttatttattgatgccctgtaatgcccttcacttctttgtgcacacactgaattttaattcagtcttcacagtcctgcttaaccatcacagcttctgtgaactttttctgtatatcattttgctctcatttcaacaaaattaatcacttttgctattttatagctgtagattacatatccctcttgtactgggtctttataatattttgtactcatttggatacaaatacttctactgctataggatgggtttcccttaaagtaagtattatgcctttcttgtttatctttattattcagagcaaacatgtattttggtgaaagcaaaggcaagttaatggaactgatgtatctttaagttattgtctactgtttattttctctagttttatgttttaatgtaggctgatgttttcatttcttcctttcattaatccatttctttattactgctaaaagttaactagtatttgttgttagttttttgttttcttttgttttagagacagggtctcactatgtcactatcttgcccaggctgtactcaaactccttggttcaagccatcctcctgccttggactcccaaatagctgagactataggcatatgacactgtgcctggctgggtttttgttttgttttgttttgttttgtttttgttatttttaacatcatatgatacttgattgacttttctaaacccgtggattaatatctgcttctaaagtaaaaaattgttaaccttgttattgaaagctagaaagagaaaatgtctggcttaaaggctatcctaaatttttgaaaaattcttatgagaatataatcatctatataaagggtacatttggaaaatacaggtatatctttaagaaagattcagaatttacaagaaaaaatattgaatatgaagatgattagacaattgaacaaatatgtagataaatacatcaatttttacaaaacatgaaatagcattaaaaagagaagaatttatcactgctatcacttatcactgttgcagaggtccgattaatgcagtaagaaataggagtttaaaagttggacataaattgatcagataattattattttctgataatatttcctgtaaaatccaagataatccactgaaaatatagaaccagttgaacaatctacaaattgactggagtcaagagaaatatatataaaacagttgcattcctgttctcacaaaattactcataaaataattagaaacttctgtttcaaattgggatgtagaacagtaagaaagaacttcgctttcatggtaacaacaagaaaaccagactaaagaaatatctttttctatgagtctgtcaaggagcaagcaatgcagaaaaccctggctgaattgaattttaggaagaaataagtgcttcataggtgatcagagtgctgtggcagcttccatatctgaggctaaacacttgttcagacagcggaggagtatgctattgtagatggggagaatttttaaggtcaaggggaaaccatccacccttagacaacaatgtagcctagtaagatgaaattagatctaaaagtctaaatgccaaagcaagtagctcagccccaggttacactattatcctccacacttgaattttgctaagataaagtcagttgaagaggccctagaagtggattcctatgaaattttgccatgattggattccagaattatgaataaatttaatccaaatatgagccaaaaatatttatagtcccagccaagtcccccgctagctcaaatgaggataagatccaaaaggtggcatcaccaatggttgaaggttgagctaaacacaagtgaactaaatacaattaaagcccaacttcagttctacataagtcagtagaaatgtatccacagattgccaaattactgtaattagaaagcaaagaatttaaagcaaatattgtaaacatttaaaaaaaattaaaggtaaaattcatataatggatgaaaagataaaatattttaagagataaatgatagctctaagaagaaataaaatggaaattctagatctgaaaagtataaatttacaataaaaactttattggataagtataatagcaaattggtcagtgcagaataaaagattaatgaatttaaacacatatcattatgaagtaaccaaagaaaaatgaagagaaaaataggttaaaaaataaacagatcgataacatgtggaataatatcaggagatttaacatacatggagatgtgggttccaggaagaagaaataggcagaaaaatatttgaagaaataactgttgctaaatattcaaatttgatgatgaaacaacctaaaaatgcaagaagctcaatgaattccaagtagaataagtataatatagccacatattgtatactcacagtccgattactaaaaaaaaaagattatggaaataaaaaccttaaaatcagctagagaaaaggaaaaaggcactacatagaagaaaacaatgaaatgaatgaaggctaacatttcatcaaaaataattgaggctagaagataatacaatatctttagaaactttaaaacaccaatctcaattctatattcagtgaacgtattattcaaaaataatttgaaagacatttttagattaaagaaagagttagtatatcatgaatagtcttgcattacaagaagtgctaaaaaaagttttaggctaaaaataccaataataactcaagtgtgaggaaaaaatgaaggaaaatggaaattaaaaatgtgaataaacagaaaatattattaaaaactcttttgaagacatttgattagtgaaaacaagaaattttaaacatattctgcagtttacaacatatataaaattaaactgtataaaaaatagtacaaataattggacaatggtaaatggaagtatgttgctgtaaggatcttatatgtgaagtagtataatgttaatttgtgatagtatgtgtgttaagaatgcatatgatgatccttagagagccattttaaaaagtctaaagtctacctagggagatgaaaaaggtagcaaaatggaatgttaaggtaactcctctaatccataacaaggtagggaaggcacagcaaagaagcaaacagcaaatgcaaaaaaaaaaaagaagaagaaagtaagaaaagagagaattcaaatagcaagatggtaaaattaagttaaaaacatattaataattatgttgaatataaatgcacataacacaacaatcaaaaagaatagattattaaactggctaaataagcaagacttacaaagggtgtacaagaaacacacttcaagtataaaaacataaaaagcttaaaagtaaaaggatggaaaaaataaaccatgaaacatttatcataagaaaatggtagtggcaatatttatatcagccaaaattacctttaagaccagtaatattactaaacagacattttataatgatagtcaattgattaagaagaaattatcctaaatgtgcttatatgtagtaatagagtttcaaaatacataaagcagaagtttacaaaccaaaggacaaaatagacaaattcccttctatatttcaagatttttaaatgactttcttagtacttaataaaagaagttgataaaaatctataaaaatacagaaaaatcaaacacactatcaacaaacttcagtgacagttattgtacattctatacaaaactggaaaatagctattgtttttcaaatgtacatggaaagtatgtatatttgaaagtatgtacactacaaacattctacagctaatatgctgggccataaaagaatcttaatatatttaaaaagttgaagtcagaatatattctctgtttatatagaattaaattagaaatcagtctgaaaatgctatctggaaattttctaaatacttcaaattaaacaacacatttctaaatgccctaccaattaaggggaattttttaacaaaaaataaagtataacatgaactttttggaatgcaccccaagtaaggcctggagagaaatgtataggttaaatggttatcttagaagaaaaaagtccaagctttcctaagcttcttcttaaaacaggcaaaaaagaacaaattaagaccaaagtaataagaaatgaaaaaaattaaggcagaattggatatcaatgaaatggaaacagaaagcaaagcccagaattgatttgcaagaattatgggtgttggggaatggagagtggtaaggggagagaaggaggggggagagagaaaaggagaggaagagagagaaaaaaatattttggattaattttaaaaatctatcgatatgatttaccacattaatagaggaaatagtatagcaaaatatcatattatctcaatacagctgaaagacatttcacaaaattttatacctattcataatgaaaactttcagcaaactaagaataggagagatgaaggaccactacaaatattctacagaatacatatacatatatatatatatagtatacatatatgaaatgtacactacaaatattctacagctaatatgctgggccgtaaaacaggcaaaatatatatacaatatatatttaatatatatttattatatatacttatacatacttaatatacttatatatttatatatataaatatataaaagtgaaatagtgcatgttttgattttaagatagggatcaagttttcgttcaaactttaccagtagttctagccactgctaaaacaatacgataatataaaagtcataaatatagaaaaggaaaagaaaatgtatttgtcatcgacataattttgtatgtaaatgctttaaaaaatctttgaaaaagtgttaaaactaataaatgaacttggaaagattgcagaatacaatgttaatataaacaaaattaattgaacatactagcaataaacaatttaaacaaagttggatttaaaagaatattcaaaacatagcacttaaatttaacaaaataaatgaaaatatttgtatagccaaagctataaaacataacttagaaaaatcaatgtaaacctaaatagatgaagatttatcatgtttgtggatgaaaaacaaaatattgttaaaatagccattttcctgaagtcaatttattcatttaatgtaattccaatcaaaattccagcaagcttttttgaagaaattcccaagttgattctacaagttgaaagacctagaatatccaaaatactattgaataaagtattaaaaaaatggcaaactgagccatcttatttcaagatttaaaataaagccataataattaagacttcatagtatttgtactggcaaattaatcagaaatagactcagacttccaatgtcaattaaaatttgatagaggtaaggcagttcaatggggcgagtacaatcttttcaacaaatagtactgtatagtgtataggagtcaaaaaaaaacaataaagcttgacccctatctcacatcatgcatacaatttaatttgagatgggttcatagacctaataaataaaagctgaaattataaagcttctagaagataaatgagaaaatatcttgatcatcttggtgttggtaaagatttctcagacaaggtacaaacaaagcgctaaccattaaaaaatggtaaattcaacttcatctaaaatattaagaaaatgattgccattctaactgatgtgagatggtatctcattatggttttgatttgcatttctctgatggccagtgatgaagagcattttttcatgtgtctgttggctgcataaatgtcttcttttgagaagtatgtgttcatatccttcgcccactttttgatggggttgtttgtttctttcttgtaaatttgtttgattctggatattagccctttgtcagatgagtagattgcaaaaaatttctcccattctgtaggttgcctgttcactctgatggtagtttcttttgctgtgcagaagctctttagtttaattagatcccatttgtcaattttggcttttgttgccattgctttttgtgttttagacatgaagtccttgcccatgcctatgtcctgaatggtattgcctaggttttcttctagggtttttatgcttttaggtctaacatttaagtctttaatccatcttgaattaatttttgtataaggtgtaaggaagggatccagtttcagctttctacatatggctagccagttttcccagcaccatttatttaatagtgaatcctttccccatttcttattttcgtcaggtttgtcaaagatcagatggttgtacatatgtggcattatttctgaaggctctgttctgttccattggtctatgtccaacaatgacagactggattaagaaaatgtggtgcatatacaccatgaaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccagggcctgttgtggggtggggggaggagggagggaaagcatttggagatatacctaatgtaaatgatgagttaatgggtgcagcacaccaacatgacacatatatgcatatgtaacaaacctgcacgttgtgcacatgtaccctaaaacttaaagtataaaaaaaaagaatcaaaactttaaattaaaaaaaaaatgaaaaggtaagtcaaagactggattcggctaggtatatgtttaacttagagaatgccaagcagttttccaaaatgattgtttaattttgcctttacattagcatgtatgagagtttccattgcatcacctattcagcagattttggtgtttttaatttgaccaattctagtgagtatggagatgtgtctcattgtagttttaatttgcagttcctggatgaatgatgacactgaacatctttctcatgagcaaatatggttatttgcatatcagaatttttagtcaagtgattgtttagacgttttgctcattttctattgggttgcttggctttttattgagttgtaggatttttttatgtattctacatgtccattgtaagaatttaaatttctgataaaagattaaaaaaatctatagtaactttttagcagctttttcattcatactagggacttgtattacaggttccttctcttgatttggattttggaaggcaaaattttcatcagctgaaatgtattagttcttgatttctttttgttcttacaatagctttgtatggctattacttgacaatttccaatcattttgaaatgtcttacattttcctgtatctgcaataacaaagttaagttgacagggataaaggcttttggatggctttttatgtttcttagttcaagagagacacatttggtttttgaaaaatgtttgtgttgaagtctaacatacatacagaaaagtgcaaaaagtagcagtgtgcaggttgacccatttttataacccggatagccttgtgtacccagcacccacagtacaaaatagaacactactgggcccccagtgggcctgccttgtgccctttctaaatcccagccaggattacctctatccagacttctaacatcatacgtggatttttgtctagttttgaacttgatataaatgggatcatacagtatatattcctgtgtacttagtatctcttacacaatccatgtttgtgagattcatgtatatagttgttcattctcattgctatatctgttgtttgtacagttgagtgacacgtgtgtatgtttcagtttgaaggtgtaatgaaaggtcttgctgtaaacatacttgtatatcttgtgaccctatgcatttgggtggggctggatgtagatccaggagtagaacggctggatgaaaacatacatatatcaaaagatacaagggtaacttttttgtttgtttttgagacggaatctcgttctgtcgcccaggctggagtgcagtggcgcgatctccactcactgcaagctccgcctttcgggttcacaccattctcctggctcagcctcccgagtagctgggactacaggcgcccgccacgacgcccggctaatttttttgtacttttagtagagacgaggtttcgccgtgttatccaggatggtctcggtctcctgacctcgtgatccgcctgcctcggcctcccaaagtgctgggattacaggcgtgagccactgtgcccggcccacaagtataacttaataaatactgtcagtttttaaaagaggttgtacgctccaactagtagtttatgaatgttgcatgtatagatattattacattatatattataaatttaacattttactttttaatttaatattatatataaaaatatatgtaatatatacgtgtgtgtatgtgtacatacacacatatacagtagttgcacatatttggctacactttgtgtttccttttcattttagccattctaatggatatttagtggtattgcatttcattttgcatttctcagatgactaatgataccgaccatctttttcatattttttttttctggctatgtatcttggtatcagatatatgtattgcaaatatctgctttcactatgtcatttgtcttttcattctcttattcataccttttgatagccaaaagttgttaattctaacatggtctaatttatcaacttttccctttatgttatagcttcacatttatcgtttaagaattctttgcctaatccatggccccgaacgtgtatgatttttatgattaaattttaaagttgtaaacctcttacttgaaagttaaatatttccatgtagaacttggatttttcatatttttagaatgttaggccatggatgtaagtttattttacacatctcatgtataccatttgtacaaagtatgtgttccttaaatatttcctgaatgaatgaatatagagatgcatgaaatgctctattgtttaaacactagaaaccaaaacactgaactttagaacatttcctgtctcattttttgaaaatcaaagtctaaatttcagaaagtgagaaaagtataattttcacttgtctgcccattttagtcagtgtttcagcttaacacaaacattaaaagcaaaaatattttggcactgctgggctctgatccacagctcttcttattcctgggcccaggatgataacacattcatgaggcagaggggaagacaagttcaactacacagctgtattaaaatttctgctctcctgcgcacaccgcatgtccactttcatttctttggccaacacaagtcacatcactaagcctaagtcaatagttgggaatctgtaaatacataatcttcttataggaaaagagagtgttaataattttgaatagttatgcatgttaccattctgtctcacggtagagtcagtaatgttttctttaaaatgttttatatgttaatcaaaatattatgtttatatttaaatgtattcttttttatttagttcatttaaagaattgattacatgatttcagcatttggctcaaaagatagaatttatctatatctatggcaataattaattgtcaagaatatgtttcagtgaacgtgtgcatttttaattttgtcatagattttgcacaaaagacattcattatttattttggcagtgtaaagagaaaaatgagaagattaaattatttggaaaatgctgtgggaaagtctcacatacaccatcaattccaattgcctttttttatactatagcttcccttcttaagaaattttccttgatctgtgtaaaatattatattttagttgcactagcagtgcattttctcatataagcataaaacttgaaaattaaataatatattttagaaaaacacacgaacttgcatatttcttaaatagtgcataatttttatgagattcccacgtatatcttgtctaaatattcctgtaattcttactgatttattttcattcatcagatttctcttgaattaaagacaagtagttgtcttcccagattgagcaattattgatatcttccaacacccaattccttgtttttattctcctctctactgccacatagatgactccaacacactggtagagagttttgctctcttcatgttccaaattatagcatttttgtgaaataacctcaagctgagtaattttataggaataggttttattataatatatgataccaaatatcacataaaaagtggtgacagaaagataagatttctcaagtagtgttactctgaaccataaggagagaagcttaagagaagaaaagagttggtagaaatataattgttctctgctcaggttgtagaccagactctacgtctatgtttctgctggtagatgcttccttttatctccctggtctaccctgataattaatttatatgtctcccatttctttctctatcagatttttctaattcgtgttctgtacccaccttctactcattcatttcctcagtccttatcacccagcagtcaagagtctgtccattctacttaactgaaaaagattatgtcattaccagctccgtaagtttttcttcagttctaattattctggacctattggaagtgtttacacagttaactaaccttgcctccttaaagttccctcctatctagatttccattttacaatattatcttgatctaactttattcttgcccttgtttttttcttttctgaaatgtggacatttccattaaaggctcttgttctttttctacaatctgtctcttagacatggcttttgataggtgattgccaatgtattttcctagcatcgtcttctcttctaagatttagtttctcatttccaaatggcaggcagagttttctgcatcataagttcagtatgcctaaaactaaagataattcctaaccccagatttccttccttatctgacatttctatttctgttattaatgccccattttcctcaataattggtgaaaagaatggaccattttgccccacaccatcacctcatatcaatatgtcttaatgtgcctttcctggtatgtatagagtttatcctttcaattactaattcagttacttgtctgtccttgtcttattctcccaaagcacagcactcacctcttttctgtgtagctaagttacgtctcctccctacatttcatcatgaattttgttgccttagtctcaattttgaaaatcctattcctgctctccactcaaattttaatttcttccattaatttatgggatatgtttcaaatgggtggctcaatcatttcagtgcacttaataggggagatgagagagaacaatacatctagtagcaggagtccaagtgtgtttgactactgaaaagcaatttgttggggcaaacaattctattctgtggagtggaagagttgccaggaaggactgcatcctgaatctgacagcaagaacacaacattcaagcaggccagagtaagagaagaagagagtgtgtaacaatgagaaataaaaatcactaggacaagtttgttgaaaatgaccaagagcataaaacgtagaagatggagatgcagaagtcaagaaggccaggataaatttgatttgccttcttggaaagtctaaagcttgtatcctaaacttaacctttgctgtgactaaaggaatagcactctaaaaatgacttagaacacagcattctttttcatctttgtcttctatacaaacttctcaagccagattgtacagatgtggtctcacctatttctccagatttatctaactgtctccctcacaaccagccttcctcaaactttccatacctctaggactttgtacaattcccgccaaatccttcatattctctaaaaacaagctgaagtactatattatctaaaactgtcctcaatttcttttaatcaggtattttgtatacatccctataccatttatcacattgcattacatttttttaattgtcttttttctcaactagaactcaatgtcagttatgggcttattagtttttcttctttgctgtgtatcggagtactattcaacaaatgttagtgttccatagatgtatgttgaaaaaacgacagtccaatgttcaccaaatgatatctgctttcctgccttcaaatcctagctaaagtttttctcttcagacatggcttctggagtagttgctgtctattgaaactgagttaaccaccacccacctatgtagggcttttggttaccagcccagcctgaaggaagatctccttcctttaaatttttattatcctgcctgactgtatttttactcaaatcagtattcattcattattcactattgtgttcttgagatgttatttgattttcatatatggtcttgagctcttatttgattccacaggataatttgttaagacatatacatttaatattttcaactaaactggaaattccttgaaaacagagattgtgtctcttaccagttttaatgcattaagcaaaaagccttatacagggcaagagctccacagtatgtgttgagtacgtgggatactgagtagagtggagatggggccatgtaatggtaggactggagatggggccatgtaatggtagggggaaggcatcattcataggactggagatggggccatgtaacggtagggggaaggcatcattcataggactggagatggggccatgtaatggtagggcgaaggcatcattcatagggctggagatggggacatgtaaaggtaggggggaggcatcattcataggactggagatggggccatgtaatggtaggggggtgacatcattcatagggctggagatggggacatgtaatggtagggagaaggcatcattcatagggctgttgcatattgcccctgcttcctaagctgtggaaatttctatgagaaaagagcattgtatatcctatgatatgcagggctagtatgtgctctgaagggtcagtaaagatcccaaaattctgaaggctgcaaaccatttggttatagggtggtgtttcaggaaattacctctataggcctcttcatggcaggtctttccaatattaacttctattactgaaccgattctttaaacttcataaatattttaagcaagaccctctgtgtttctttcactcttgtcaaaaacccatttatttttatgactctctgataatgttttcacattgatactctgagtatccaattttgggttgacaatatgtctttttgggttgatgagttttgcataaatttaaacttcattatatattgattagcaggaatgtgggcataagattccaagtactgaatggcatttaaaatgggatatatttaaaaccaaatggcctagaccatgcgagtatattgctgtgtataatttcctgactgtactcactacatcataaataataatgaaagtaaatgtacatttatcagaaagaatcaacaaaaccccagcactgatttgctgatcacacttgtcttaccaggcattaaggccagctttcgaacaaaagtgcctgaaggtttgattgtctttgcagcatcacctggcaatcaggaagagtattttgcacttcagttgaagaagggacgtctttattttctttttgatcctcaggtaaatgagaaatcataaactttaatatttttaagaatttagtaggtgcctggtactgaggtaaatgcttctgttttcacactgaatcttcattcaaaccttgtaaggtaagtactattattatccccattttgccaatcaagaaaatgaaacttacaaaagtaatgtgacttgccctcagctaaaatagcggagctaacttttaaaccatcatggtctgactgagaatctgtgggcttaacaaccaaaatgccaccttataatgaagattaaaacttttaaataaatttaaagagatctatttttatttttcttagtagcaaaaaatcatgtccccttttcttccttccctgtctttcttttttcattgtttcaccagcaaatatttaagtggctatcgggtactatggtactgggcgttgcagactaccatagtttcaaagttaaatatgaccatgcccctgcaaaggatacagtaaaataatcaatttaaaattcttataaattgtatcaaaataaagatttaggattctatgtattataggaacataaaataaagaaataaattgttttctgagttgtcaattttctctggaaatgtgatatttaactgagatacaaatcaatgaagaaaagttggtcaggacaagattatatgtctgtatttgagggtgtatatttcaggtggggcagtacaggggagattctgatctccacctgggaaggtgctgagcataaagtttccaggcaaagtgagcagcaaatattaaggaaatagcaaatattaagtgcctgaggtggacgagaacatggcacattcagtacactgagatgaatctcttatggctgggaacagagacaaagggaaaggtggtagattgaaaagctgggtagaaaccaagtcatttaagaccttgtaagcaaatgtgaggatatgaatttttcctaagggcagtgagaaagcactgaacagttgtcttcacttgagttgaacaaatatcagtgagcatttgatattaggtattgtattaagcatgtgagatgagtaagagaaatgagtaagactaagtaaaatatattagctttccattttctcagttcttcaacttaaaactgatgatctaaatcacacgttatgcttgacaaataaatgttttacattttattggtaaagcagacacaacgttcaccctctgtatccaagttgcgtctaggatcatggactgagtgatctgactgaggatctcagcctcatgaaccctggagatccattgaccttagagagaaaaggcagggcctattgtaccaagtgtatctgaggaccctgccagactcaaaaagcaggccaaagtcctcctgctttatgaagctgggagagccgcacagtggccactcgaaggaccagggacagaaaggctccctcctcatgacttgacagggctctgctaactccctggctggtgcacagcaggtcctcagacacaaagatttctgagcgtcccctagtaatgcagcttcttaaaggatgccagcaggtgggcagtgagtaagcaaaaggaaatagcatcacacctaagcagatcctgcagccagagggaaaggaagaagcagcagctatcgcagaaggcaagacagatggcaactgaaaaaaatttttaaaaaatcagctgaagttgattcaattacataatggaagatattattttttatttgaaaactttaagtagattaattagaggagagacactgagcctcagattagtaggtcagaagattaagttgaagaaatctctcaaaatacataaaaatgtgacaaaaacaagaaagttagatactactactgtcactaagaagcgaatcggaaggagaacaaaaagcacatgctcaagaaaaagagggataacataaaatgatgaaacaaaaaataggagagaatatctgatttaagagggaatttagtataaatccattgaaaagactcatcaatttcctgtcaagattaagcaaaactaatacttctatgagacctctttgtgccaggcattattctaagtggtctctctatacatcagtttgtacacttacatacacacatatgcctatacacacacacacacacacacacacctacacacgcacataaactcatttgaacttttcaacaactctgtgaggtagatactcttcatattcccattttacaggtgaggaatctgggccacaggtaagttaattttccccaagtcacaacactaataagtgaccaagccaggttataaacacaagcaattgagctccaaagaccatgattttagctacagtgctatactgcttttcaacatgaaagaaagatggttgttgatatccataaattcagaaaaaaaaaatccatctctgcaccaggttggaaagaaatatttcagtaagtaatctagccaaaaggaaaaataacagagtcagaaatataaaaagaagaagcatcagtgaataataaatctagtaatattaagttatgcctaaatatttaatgatagagtgactagaactctgttttacagtgccaaatgagaatctttgaaatagaagagaagtatagcaaaggcaagaaaaaaaacgtgaataatcatttgttgctaaaattagtaagatttgaaggagaggaaagatgagtgaattaaaagttctgaagataccagcttagtggcggggtgtgggtggaataagggaatagattatactgacgttttgttttcgttaaataaatagggcaaatgtttgatttcaaatgttatagaaaaataagttactactaataaaaagtgctcttcaggacatccaaattaacaaggttaaaaaggacagcaaatgctaagttaaaaaatcaacaaaaatcagaaaaagaaaggggagagtacagtaaaatagaagactgtcaatgagaaagaaaaatctggctctgctttttccccttcaacctgttagtatctggagatatttaagaagaagccagatggaaaaaaaactaatcacaggaccacttgtttatagagctttaaagtatacaaagtgagttcctgttaatgatctcatttcattcttgaagtagccccttgaggttgattttgttttcatccctgctttagatgaagtggcttaactacggtcatagagtggtttagggatagaactagcactgaattcaattatttgaatagcactgaattattttattcaatgaaactttgctaagaatttattggacttcacagttatgcactgggaacacagaaatgaacagaatgacactcattggaattctggccattggttgttcatcacagattttgagtatttatagccacccccctaccaaacatgggacagtcattggagaattaatccaaaaatgatttccccaagtctgaagcatgactgccatctcttttgacatgtggtgttgctatttctaaaggatgcgataccttaagactctgtaggataggagggtaaaggggtcaaactgcttaacggagaatggctgccaggaaactcatctggcaggtctagttgttttcatatcctttacggtgatcacctggacaggctggtgcaaagcgtggtaacagaattcagggaaacattcacagggcatttgcccatcatttccgcccccttacccttctcattcacacaattgcttagagtactcgtcactgctattagttttcccagttgctctgtccctaccctgtatagccaaaccctaagctgtatacatagtccgcaggtgccagccaagtattaataaaattgttaaagccactgggcgtggtggctcatgcctgtaatcctagcactttgggaggctgaggcgggtggatcacaaggtcaggagttcaagaccagcctggctaagatggtgaaaccccgtttctactaaaaatacaaaacttagctgggcgtggtggcaggtgcctgtaatccccgctactcgggagactgaggcagagaattgcttgaacccgggaggcagaggttacagtgagccgagactgagccactgcactccaacctgggtgacagagtgagaccttgtctcaaaaaaaaaaaaattgttaaagccaagttgggggctaaagggagtgaggaaggtttaatgatgtctagtaagtaaatttttatctgaaataatctctctccataaggtaaaactgcttgagttttcaggaaagtgacaattattttttaaaatacaagatatgggttgagcaggatggccttaggatctagctgagaaaatgtaatcagatgcattacactatgtgctcacgggccatgaggctctctatatatgaaacaacgagcttatgctagcaaggactgtgtccttccttacttccaatgaatttatactctaaaacaggtactaaacatattttctaaatttataatgaaagccccactcatttttagacaaagaagtgttaaaactgagggatggtgaaaattttgaatactcttctcttatttgctctctttttccaaagtaatatcaatgcagcttcttgtatgaagttagagctactctgggttttaaaaagtatagaagtttatttcatatgccttctattggcattacatttatttatattttaaatactttgggtaccactttaagtcagtttttctcctttaatctttaaatgcggacgagattatctagtgaatactttttatactcatcacacaagtaattatgtacttagtgtgtctgtcttatcagactgtatgatccagtgagggcaaagtctatgaatcttttgcccacaggtacttcctcaggacttagaacagtctttggaacatagtagatgcccagtaaataaatgaccattgacatattacctggctgattgactcaataactgttggtaggatactactactcataactgaagaaaattatccatttttctggcttacaacgtctagctttgtaatgattacacagatattttgtgatgtttgttttatttttttttattttgaaaaaattagagaaaaagtcttgctgttttgctcaggttggtcccgaactcctggcctcaagcaatcctcccaccttggcctctcaaagtgctaggattacagacatgagacaccatgcccagccttgttcaaatttgtctgtttttcagataatttgatttttatcaggaaaaaacgagatgcttatttttaaattgtttttactgaattcattcaaaatagccaaattttgaattatgaagagaatttcaaggaattttaaagtagttatctagcacatatttataaaataacttgaagtcattgtgtactttgctctttttaaaatatcttaataaaattgagtattaaattccttacaaaacaatttaatacaacgtagaggctatagatataaaaatgtatttggtttgtcatccaactatccgaagcattctattgaataaatgtttagggaaagggagattcttcatagtacataaaattggaaatgtgtttgtatattacaaactgggcacttgccattgttaaaagatacaataaagaaaagttaactgcaacttttaattacagtttttattgttatctccaacaattttctataattttcccattcttcacttaattaaattcaattttgaatatacttgatcagataatattttagtgaccagtaatgatctatgtttatcccttaaatattctatgttcagtgacattaacaggaaattcacatcatattctgggcttacttggaaggaagctgtgaaaatgaaagctttaaaacaattctgaatagcatctattgaatgtgtctgatatgttccaaatagaaagaacaacatgcataatatgacaccagaagtcatcacagaattgttctttcaacattgatggggggaagtaatcttaaaatagtcttcaaaaaatgatattctaaattgctgtaagtataaagtgagtttgtcatgctgaggctgtaggtaatgtacttgaatttgtctccaataaacttgatttctgatgtagagaactattaatgcttcagattgttgccaaacaaaatatgaagaaccacttattcagacacctgatctttagaatgcagcatcgtttgtaacaattttaacgctaactaagtacactttgatgagacagcatttaataaaatgctcattaatttcatcattagcaagggtatgctaagaagtaagccagtttcttatgtcacgcccaattagcatcccatgctagtaatcccattagtattgttgaattcactaatggaaaaactaatgggcatgctaccagggcacattaattgggcacgacaccagttctggttttaattattaaactacgataatgaaatgtgtgtttgtaaaatattaaaatgttgaaatagggttgaagaaaataaaagggtgtgtagacaaaacagatataaggaaagtcaacctacaaaaatacgaagactagaacttgccagatggtcatgtttctagctgatggagttgtctgtaaaagttgggatattgtccatgtgagagacaacccactcatactcatgggaaattaaaagctttttttttttttttttttactttggtaacatgaaattctgtatgtcatacatgttgtcgagctctttatgaggcccgacaggaaccaattaaatgtgtagagtggacatgttgtatcactgaagccatttcagagaaagataaacagaaatcatactaaagatggtatgattaacattgtatgtttttcaatatacatcttcagcaccattacatcaaacaattatctattttctctttttgaaaaaaacagcatagcaaaattattagagtttggtgaaattttctggtaattaagtgttttggtaatattttacccaatctaatttttttaatttttaaagattttattagaatgagctttattcttgttaagtaaatcaactttattaagaagaaaattcattcccatttagaagttgtaatttcttttttatttttatttaatagtagtactagtagctgttggtgacaaagttgggatatctttcacttagtcttattcacttaacacagaaaatgttactataggtaaccaaggctactataacatactggaaaattgtttacttttctcgaaagtagtgagatggcaggtgtttcttctatttctctttctcagtttttttttttattcttacctcctatttgctaaactctgttcttaatatctgccatttcctatgtcttatcacttaggaacatgtttttaactattatatgattaccttagccagaactataattattggattttaactacaaagcattgtgtactacatttaactccacccttatgtttaatgtatcacaactggctagtttttaaggtgaatgtcattcccatttgttattgataattttgtgaagataagagtgacttgtctgacatctctctatcttcagaactcattttgagtggtattttatgagttttaaatttttctcttctttttcatatttatgccatgaaacttaaagtctaaaattttagaatagaaaattctttacccttctgatgaatagctatattcatcagaaaatgcaagtgactttgtaagaaattcttactgcaaaggtgagacctttacagatctgtacactgtggtgcacagggaagtattaatacatcacaggaaagccagaatgatgctagacatcagctttaattttgagttctgtttgaaatgtatgcatgcttgtatcaggatcataatcttgaaacttgtaaattggtttataacaaatatgtgtgtgtttatttgtagatatgcatgtataaacatttatttattcattcattcccttaaggggtcaccagtggaagtaactacaactaatgatcatggcaaacaatatagtgatggaaaatggcatgaaataattgctattaggcatcaggcttttggccaaatcactctggatgggatatatacaggtaagtactttttgatatgtataaatagccctgttgatatgttggtgttgccatacttttctgttgtttatattcctacattcttatttcaccataatttctactcaattccatatatattgctgttgaatttgcctttgggatgctcctaaaaggatgaagtctggcaaccagtttttcatccatgaaggtctttggtaaagaaaaaaataacaatgaagtcacctatgtcttttacagttctttacaattcgtgtggacctttagttatgttctgtcatcttacttttgacttccaaaaaacacatacagtagaggaaagcagtttttgtctgcatttggagatgaggaaaccaaggctgagaaaaaagtaaatattttttcctaacttacacagttgagaggaagcattcttgggacacacatcctgttttttcacatttaagtttagtttttgctccagcctaccctatctgccacatttatgtaattataacatgatcactgtacctgtataatgatgcaggcttttattaaattattcaggaaatatctaattttaatcagtacctattatgttccaggtattgttctaggtgctctggatacaaggagcaaagagaatactgtaaaacttacattttatgggaggaatggggcagcaaaatacagaataaataaatttaaacaaatatcaagtggtgataaattctgagaatgaaaaagccagatgagagggaaagttgtgtgtgtatgtgcgtgtgtgtgttaagaaaggtctctctgatgaggtgacatttgagcagagacctaaagggacaaaggggaaaccatgtaaatatccaggaagaggatgctttgggttgcgaggacagcaagtatcagggccctgaagtgagagcacactacatgtggcatgtcaaggaccaacaagaaggccagtgtgggaaagagggtgtaaaagagctaatgacatgacataaggtcacagaggccattagggatcagattatatgggaccttgtgggcttttactttgaaagaaggaaactgttgaaggattttgagggaagaatgacataatatgacggctttctttaaaaggatcacactagctgctctgttgagaataaattttaaggggaatgagggtgaaggcatggagatcagttaataggcttctgcaataactctgtaataattcagacaagaaatcatggagacctgaaccagggtgataattgaagatataataagaagtattcagattctggttatactgtgaatgtcaaattaacaggatttggtgatgagattgaggcagaataggggttggtaaactatcaccatgggctaaatctagctcatgcctgtttttataaagttttattggagcacaactacacccattcatttacgtattatctatggctgcttgagtctgaatagtctacaaagacactgtctggcctttgacagagtttactggcccttaatgtcgagcaagcctgtcaggtttgggtctcaggcaactggaagaatgtagctgccaaaaccagggagtgcatgactgtgggagaagcaggtttggggagagacattcaaagttcagttgagaacatgttaaggctgagatttctaagacacccaaggggagatatcaggcaggctgctcaagaaacaagtctagttctgaagtcagaacttccagcaaaggatggtattgaaagccaagggaacagatgtaagtagggctaattggagtggattgggctctggaaaaacaaacacaaataactttgcctcttctctcaaagaaggtgggcattagaaatatgaacagggatttccattgttatgccacacagtcagagacccaggttcccctggcctttggccctggcagttcgtactggaacccagcccactattcatccctctagagtacttagggggtgcctatgggtagagaaaggaagaggcctgagaggcaggcggtctggatcattccaacatcatgatgctgggatgttgaggaagagccagtgaagaaaagtaatgaacaggcaatgaggagagaggaaaaccaagagagtggtatcccaaaggctggtgaaggattttattatttgctgagctagtaaaactagagtatcctggtgaaggtgtatttctcatctcctcttctctaggttcctctgccatcctgaatggtagtactgttattggagataacacaggagtctttctgggagggctcccgcgaagttataccatcctcaggaaggatcctggtgagtttagtaaggtatattatatgttgtcatccaaacttagaatagaacctgtttacattattttaaagtaagaataagtattatgttctacctcatgctatattttctatattaatgtgccaaaaatttcctttaggtctcttttttttaaaggaaccatgtattccatatgacttgtatttatattgttagtactcggttcttgatatataaaaggaattcattaaaacttttgctgaaatgaattataataatttcagtcaaaggtatgttattttaggacctatgcatagttttttctaagattttaaattgaatgtgaaacaacacagaaatggaaaactatgagcttgatttatactctaaatagggtgaagaacattccctgaatactatgtgataggcactaaaccaatccctagatattcatagatgaataaaatgtggtctttatcacaatagaggtcacaggcgtataaacagacaattccagcctaatgccattagtgctataattgagctatagacaaagtgattctcatatttttagaacaagagcataagaacatattctaaaatgaaactaattaaaatgaacatgaatggaattaaccttagataggaaaaaaaatcacccttcaaacgcaatgctaatattctaggattgtttcccaagtcctcattaagaatcacagggtgcctcccaagtctctcccaggaagttaaaatataactacataaatattacaaataagctagaacccagataagtataatttgttcatgggttgcagtctcagggaatcatgatgaagatcaaaaggaatagaaagtgttcatcaaatttaggagaaggatatagttgaatcctcaaggctgattatagttacctcctcagaaatgtctctagattagagagggttttcattcaactacttgagactgacagagaagtccctctaaaacacacacacacacacacacacacacacacactcacgtacacagcctttgttttttgcccttctgggaaatagtatcttcaggtactaggagagaataccctgatactaagtacccttcctgtagaggacacatctccattatgaataaccaattttactttgtctatgtaaattggccttataaaactctcataaactcaaagctgaaaactaagctttgcccccataggaaaggaggtggctgtgtgaaattcgacctcagtgcaccttctcctcctcttgatttttttttcttgctttttctctaattctctcatttgcacattttctctctcaaccttctgttatcaccctattcactgtatttataaagccacctctacctggtctggagagttccacattcaagatcaacactatatacatttcccaaaatatgaagccaaattattgatttacttcagtaacagactggttcatagatgaggaatctaaactgtaaactatatattaaatagaaacactcccttccaatctaacttttaaaattatagtactttatttttgaggctagtggcagatgaattttctgtgttagttgaaaaggcaatattcttgctactgcaaaaccaaggtttctgcataaacatctgtttctgcagatatgatgggtttgaaccagcactaaacattataattgctatcatttactatagctgatggtgtggtgtttacatgaatcattaagaggcttgcagtaaataggtagtgagagctagtgcctatttctttgactttaatggcacataaaattaattgcttgaaaataatctttcaaaatatatatttcttgatatctataaactcctgcagagataatccaaaaaggttttgtgggctgtctcaaggatgtacattttatgaagaattacaatccgtcagctatttgggaacctctggattggcagagttctgaagaacaaatcaacgtgtataacagctgggagggatgtcccgcttcattaaatgagggagctcagttcctaggagcaggtaatgctctaaaaaagacatgagtgttcacttaaaatctatgttctatcctttgtataatttaatctctcctgtttgattaacttgacctcatatgaacctagtatcacagaaatacttagttattccaatggtgcacacaaatatattcttgacatctgaatatgcaatataaattataagactcataagtatacatccatgtatgatatctctggtaactcatgcagttcttgatttacatatgttagcatcaccaatgtccatttgcaaatcagttgtttggaaactagaatgcagttagagaggtgtacttagaatgcactcagaaagatgtttcaaagagttttgtttactaggttaatccacaaatgcctatttatctcattatatagaagaacaatgttcttagttaattctcggctaggtaatgggttaagtaggccattgagagagaactggagactagaaccaccatccctgccattgctcaaaaggctacaatgaaaggggaggtgtaagtgtctgtagcttacccctgacatgcatgcacattgagtctctgcctgatcagagcagagacttccacccaggggaaggggagagggatgatggtggcttggtgcacccggcttgttcatcaaataaaagcccatcactgcctcctatatttacagctaagttggttggttattaagttgcttaaactgccttcagcacaaaaaggcatatgatattaataatataatctacacattttttattctgttttcatcaaggtcattctgagtttcttttagtcaatgcaaactacttattgttaatatttatctgaaacagtaataatcttacatgatacagacaacacatgatttagagagcaaatttcttcctgttaaaaagtataatatatatcaaagtctttcttagtatatcaaggtctttctgtcacttctgtgcaattacaaaaggaatttcttaacattgatttgcatcttcttttgtgagatttactcagtggcagactgtgtcctagagtttcttagcacccttacaatgctggcaatattgtgttacacatgctaatatgtacatatttttatctttaaagggttcctggaacttcatccatatatgtttcatggtggaatgaactttgagatttcctttaagttcagaactgaccaattaaatggattgcttcttttcgtttataacaaagatggacctgattttcttgctgtatgtgaattaatttgattaaaattactttaaaatataggacccaactttaaaataaataaaccatgtgttggcattacacttaattggggtttctttacaaattcacatttgttcattttttttcccagtcatttttagttttgaagtcctgtgaaacattttgtattttattatcctagtaattttttaagatgacaattgtaacaattataattttaagaaaacagactagatataaggaattaagaaaattcaatttagtatcttaagatatgaaaaacactatttccctcattatcttttgatatgagttttgaaagcatatatattatatatttttcatatgacatatagataatcaagtataataatatagtgaacactcctggacctaccaccacgcctgataactgaatattatcatttttggtctatctataaagtctttcctatcttgtttccatctcctttcagatgtcataggtaatcagaattttgtatttgttattcacatgcatttttatagtttgaacacctaatgaatgcctacaaattcttgcttttgaaatttataaaattggttttatactctctctttagcactcaacattgtttctgagtcatttatgtgtccacataggtatacattttcttggctgtgtagtatttctcttctcttaccaatgatgtattggttgttcccatgttttgcttcaatgaataagactgctataaacatttttatacatttctctaaatacaatgggcaactgtaactgcttttccttgtctttaatcattagtttgataccactgttaaatacgttattaaaattttaattcttaaaagttgttttaaagaactagcatagaaacaggagaaaaatatgaacatcttacccttagattcttgatttctaggcaaatagacaaatacaagtcttggcttttaagagtctaagatacgttcatctttttttttttttttttaacattcctagcatacacaatgccaatattgctaagaagggaaatggaaatttatcccttcatagtatttattaaaatttctgcttttttaaatatttgtttgtcctcttgtgtattgttggcttctttctctgaaacgtaatgtctatgaatcttctctgaaatgtaatgtctatgaatcttcgctgaaacgtaatgtctatgaatctaaggaccttggttctcttctttatagttgtatcttcagtgcctaagccttagcaattatcatgttaatcaatattgttgaatgaatgaatgagtgaacatgtgaatgagctcatgctgtggtgaccttcactgagcatcgttgagtcatctacatgtgcatacactgtggaggatacaaagatgtttaccatttggctcctcctcttgaggaccatatgcctgagctggaggtctatatgccctactatgccatgcttccaccctccaccttcctctattcattgctttgttactgtattaaataatactgttaactttaagtaactcttactaaaaaaaaaaaattaaaaaattaaggctgggtgcagtggctcacccctataattccagcacttttagaggcctgggattataggagggtagcttgaggccagtagttcgagaccagcctgggcaatatagtgagaccctttttctatgaaaataaaaataaaaataaaaagttagccagacactgtagctagttccagctactcgggaagctgaggcaagaggattgctgaagactgggagtcgaaggctgcagtgacctgtgattgcacctctgcactccagcctgggcaagagagctctgtctcaaaacaaacaaaacaaaaaaaaatcaatacacttagataaatatatacggagtgcctattatgtgcttggctttcttttaacacttcccatgcaactgaaaggaagcagtctttcataaaacttaacattacggtctgccatatctgaggactgaggctgctcccagattacccctcaacaactctttctattatactgacttatttcaatatgcatggttatcccctggaacttgataaactcagaatgtttccattgctgaaaccttgaatctcaaaatataacctcatatccctctagctctctcagtctctctcattaagttcaccaacgcattgacaccattggctattagcccactttctagttaacttacttgctccttacctgagccactataatgtatttcttcaaccatatttctaccaataccctgatcttgtgtcttgtattgggcttcacaaaccttgatccatcagtccagccacctcgcttttcagttctagtagctagattgctaaacactataggaaaactaatacgggtatgagaacttgttttgagctctccaattcttttattaaacagtatctattgtttacaggattttctaatatattttagatgtagaaagtgaaagaaaaataatcttaggatctagaaacactataacctgaatgtcttcaggtagtctcacactctcctgataaaaacaagcatgcatattcaactttcagtctctctatcaacttgaccgtatttgagccaagccagatttcactctctaccgactcaggggaacaaatgaacaattaccatgcttacaaccaaagaaaatatgtctaccgtcatcctagattctatcccttcctctgtaagaacttgttctacagtctcccctctttgtatgttcaactgttccctctcaattggctcttttccctcaatatatggaatgattgaaatttattttccttagtgttttttcttttgtctgtgaagcctcctccactgtacttttccttaccttcatggtcaagtgcattgaaagtggttacttttgttattgccactttttcatctcacttcagtccctaaaatgactgtacattaggttcctgcccctaccacacctttctacaaaatcacttttctaaagtggtcaatgacccccacatttcctagcccaatgatttttatttcttatattttttgtcctttttctgtcattctgtttttttcttattcttccctactgattttccaaaatactagtttctcctgatttcattaagttctcttagcttctttaaggagatcattgtcacttaaaagaactattttctactacaagacccttaaaacattggtcttgctgaggacactaatcttttcccttttctctcagtctttttacactcactgaataatcttatttattttgtcatgtattttctcctttttgctgggccatccccaaactgtgtatctttatgtttgacttcctcaaaaagagtttcatctggatgttttataggcatttcaaactcaatatatttaaaatgaactcacccctcctccttgtcaacaacaacagtcagcatttctttcaaatgcttttcataacgtgatgatggcagaacaccctcctagttacccaaaaaagatgagatgtgttcttaatttctttttaattcatctaactcatttaccttttttaccaggtcctaatgagttgcttttacaaatacttctaagattgagtcttctctttcatcagcatcatcattatccttattttaatgactctcaatatgttttcacaattaaatggatttcctaatgcatttcctgaattctagtcgagattttgttttcaatgtgtacttcttatgtctggtaggctaagcttttagtgcaaggtaatactgggaagaatatgagttttggtttcagacagacaccaaacattctttccataccagaccctcctatcactgaaagtcctttaaaatctggcttctacatagctggcaagacactacctcacctcccacctccatatgtaccctttgtcttagctaagttggtgcctttctctgaacctgatgtcctcatgtcatgcatattagtccccctccttgggggaccctccatgaatcttatatagtttctaaaaccttgctttaaacctttcccaatttccagggagcaaaaagccttctctgttctctgctttcactttactcctttcttgtcttgattgttgtattgctcccacatgtttgcctctgctactagacagtatgactcttaggagcagtgtttaccttagagcagcaggtatatggcacattgtaagagactcgatatttattgaataagtggttagacaaatgaaaaattgcttacctgaggtccttcctgaagatgatgcttttatggaaaaattcataatttttatctggcatgatttaatttgttttactcgacacaattgatctcaagattttaaatatcatatggttactgatatggtttctaacaaagtaaaaatatattaggtaaaataattatcatgagacattttgaaggaaaacctatgaacttattttttactatgaaaatttgggtgaaatatgttcacattagaaaatggtacagtcatctaatagaatacacatagaagcaattatgttagttaaagatttagaataaaaccgaaatattgaatcaaaatatgtcttacatatttgaaattgagttcactagccagttaaaataagcttaatcaagcttgacatttcattttcttattgtcttgccatattttcccccaaattaaattgatatatgaagtagtattttctcattttctaaaaattcaaagagtcatagttcaaagtgttctgttctcttcagtcattcagtcacttatgcaggggtttaatcttctaactatgttgcagcaaaagtaaaccttaggtctacataacatcgcatcacatcctataatcattagtaggtatgaatttgtttgcatcaatacaacattcttcatgtcaactataagctagaaaagtgtttcctatgttcctaagcagaaacttagggtagagtgacacatttctatagagtgctttcagggaactgttttgcttttcttcaagaaattgactttctgctctctcccaaactgcccttctgcagcctttttatatacctactttcttttttaatataaaatacagatggagctgaaaagtggaatattgaccttccggttaaataccagtcttgcctttacacaagtggatctattgctggggctatcctattgtaatggaaagtggaataaagtcattattaaaaaggaaggctctttcatatcagcaagtgtgaatggactgatgaagcatgcatcggagtccggagaccagccactggtggtgaattcaccagtttatgtgggaggaatcccacaggaactgctgaactcttatcaacatttgtgtttggaacaaggtaagttccatctggaggaattcacaaatccatacagccctggtgctaacagtttttggtggttctgtgtttcaagagatagcaatagactcaggctaaaagcagcacccaacagcatctctttttctggagaaatttaaaccttaaaaactaatgaaaacactttttcaaagagttttgtgtgttacccttaacaatgtgccatcatttataatcagcatatttatttcaatatgtcctcagtaaatagtaattaatatacatattattattaatgtgacatataattatatatgtggtacataattatatatataaattactatttactgaataaatatcaaaataaatatgttgattataaataaggtaactgaggtgcttcccaaagatgatatttatatggaaaaattagtaatttatatatttatttaaatatgtaatgcaattatatgtgagatacataattatataagaaatatatgtgtgtacatacataattatatatataattatatatataatgcatataaatgtatttcctcatatgttggataatgatcattatctgtatttacagatgaaaaaataaattaagttggtatgcataactagtaaaaaatatcaatgcaattcattgccttttctttctttgacataaatgctaattgtctccatagtttttcagtagagctttcatgtggaaaaaaaatgtggggtgtatgtggttgacttccaaacatacttgtgaaaatctatatattgtagattattaataactataagagaaaggaaaagtgcattatttacaatttaggtgagaagttaactcatagacgtttgaatgtaatcagagaaataattaatttgaaaaggctaacaatatctgtgtatcatttcttgtggcagtcatggttctgagagcttacatgagaataggtgagtcaattattcataacaagtgtgttaggcattattatttatatcctcattacagatgaggaaactgaagagcagagaggaaggtaactttcccaaggtcacatggctagtaagcagatagcaagacactaagtctctcaggcagcctgttataaagtcaactctcctttttacagtcaatgctctcttttatgggcattggtcaatgctcctttgtaaagtggggaaagcatagtaacttccagcataggaccaagcaccctcccacgtgtgaaaaaggtcctttacgtatttcaaaatctacataccctgaatggttaaaattttcatgaggcaatctttgcctatttggtaagtacataaagatttaaatgcctttgaatagaaaatatatggcaagctcttaggagacttttagaagggtagtagtaaggagttaatgaataactggggtgtaagacagtaatgacattttcaaggcacttaagatgtaacagcagctaaaaatattacattcatataagagcttctccaggttttcaggtttctgaggttagaaagaacttgaaaacccttcgtatgagtgagattacttaatcctgtttgcttctgggaaaaaaaaaataaaaacaagaaacaaaaaccctgcatgtacagccttgttctttgaattacccctaaacccattactattgatggtcctaaagacgtggctaaaaccaaaattgtaagataataacagaagtttaaaacatcaccatagacccaaagggaataattttacctacacactatgactaagtctgtgatactggaagatattttattagtgagtaatattaaatttttattactgtagtatcatccatatcagtggtctcaaaacactgaaaaaatattgacgtatggtagctggaacgtagaagtcaaaattagccattatttttactattcaagatacattgacatcacctggaatggttattaaaaatacagatgttagggacccctgtcccctaagattctgactcagatgccttgagagacactgatctatataaatagctgcatgttttatacggtgatcagggagactagtcacaatacagaggtgcagcatgtatgtagtcaattgcaattaaaacaaatcatgttcatttaatgtatttctttcaacccactatcaattgtcttaaaaacgtttttccttttctctgcttcttaattagcaccttttttttttcatcagaagctctattttgtggtcatattagtgctattttttttttaatctactaacgttgcaatcttcctccgaaccagatacaagactaattttctttcttgttttgaaaatgctgggcaacataatttgctgaagatgtgccagctcagatgatgagagtttatcttcttagaatgatcaatgaggataatcacttacatctaggttgggcatgactgggtctggcatgtggtctcacaggcaatgctctgcccaaacccctccatggagagggagagagtgggggctcaaatttagcaggcctgccaagccaagcactctgcagcagtactgccttccctagaggaagggctaatgtttttctgattagtcatcttagagctctgggccgccttttaggcatttagaggcccaggggtggtggtgtggatggggatttttttggattctcacaagggtagtggagtaagaaaagaaagcatttccactcctctcgcaaacatcccctttctccttttgttgtcctcgcatctcattcaaatgttttaggtctggggagcatttctggtggtacagagttgaaagcacgggacaaccttaactgaactctttggttgccactggaaggaccctgcactagagctcagcagcttcaagagctcagcagtctccaaggccagaggccagaggaccatttccttaggaggattagtgcttacaaacttcattttataactaactctctaggcctttttcttcatctccaaaatgaagaaagatgtatctccctgggctttcccaaattgaaaatttcatcttgtgaattaatttttatgatgttttttgctaaatttttaattttttaaacattatggtaaaatatatgtaacatgaaatttaccattgtaaccatttttaaatgtacagtttagtggcattaggtacattcacattgttttgcagatatcaccaccatccctctgaagaactcttttcatcctgcaaagctaaaactatgtacccctcaaaaaataatgtagcatttcttataacagcacttgtttgccaagctgccctttcactgttctgattttgttggtagggaagttagggtacagagaattttgataatacagttatgtgccatcagaaaattactactgataaatacattaaaattcttagcttctgaattttccagccaatgatttcatattgagcttcattgctttcaattcaattcacccaacttattgagtgtctactgtgtgtttaagatagactagcagtattgatcagtcaggactaaaaaaatgtggataatagtaaaagacatttaaaaggaaataggctgcaacttaatgtgttagaaggcataataagacatcatatgaatgctgaggagaacaatatggtcattgttactattaacttattttactgttatgcatttcattatattttatttccatttcctgctgctgtgctttaatcttgaaaagagctgatcatgtgtttgaggcctttcaaactttacagtgttttgttcggagagagagagagagagagagagagaacatgcacgctacagcaatctcaaactcggtcctgtttgtcccaatttcgtgcagttttctgcgcagagtactgccagacttcactgagctgatctctgttttcacaaaatagcatgtaattcaaagccactgctattccctggctaactggatgccttttttgtttgctgtctaacaaaaaagtggtgaatactctaaattcatttcatccgcattctctgttaaacttcacagaatggtactgcgcagtgggtgttctaaggtcacctgtgcagaatgcacattccatgaaatctcatggtgttgctattgccaacagtgaaggctggcccctgtcatgctaatggggatgtaaaactggtgaccattttgtatgttcaagattatggaactctgtgaaaaatgatagagcatagtgacagctcttctgtaggctgatgtaactcgggctaaattctatacctctgaagtgatcattatgccattcatggcaatatttcaggactaatatattttgaaattatgttctctctcctggtattctacataaaatgctcagagtgtatttttccccaatgagcttactgaataatcatgctaattcaaatattattttttggcacttaaaactgacttatatagtaacttaatctttcagaattaagagacatggggctatccccctaccataatatgaagttgcctaaattttattttatgggaagaagcggaatttagaaaatgtgggcctaaggaggtaaaataaatgctttttcagtaccaaaagttaaattagaattatccattaatgtgttttccaaataacagaactatatttctttgcaacaaattagcttgttaaaaagtaggaggcataaaaggttttccaaggaagactcgaaagtctagcaattgtatctaaccaccccccttcctcaaaatgtagtgctgcagaggacaaaaatgattggtaattaatgactcaagccctttatgcgatactaatcccttactatttgctaggtttcggtggttgcatgaaggatgttaaatttacacggggtgctgtcgttaacttggcatctgtgtccagcggtgctgtcagagtcaatctggatggatgcctatcaactgacagtgctgttaactgcaggggaaatgactccatcctggtttaccagggaaaagagcagagtgtttacgagggtggtctccagccttttacaggtaatgtggaggtcctctaaattaaatgttacatgtctcttattcatccccctttccctccctgccagcccctcattaatctatatgagtattattttaatcttgctgcatcttatttccatttaagaatacctgtatcgagtgatagcctcgcatgaaggaggttcagtatatagtgattggagtcgaggacgtacaacaggagcaggtaaatacttatcttcaaatgcatatgtgcacacacacacatgcatgtatttgtgcatttatataaaaggaaggactattaccctgaagcagtaatatttttgtagtcttctgacagagcatgccttggtttgaaaatacatctgtcaatggctaaaatgcttagtagatcagtgcttttcatttaccaagaattcactaaatacttgctcagacttgatcctttcctcttaggatgcagaagtaaggaaagttcaggttgtcttaaggatgtaatagtcccacctacctaacatgtctaaggataggtaacctttacagatggtgtagatagcaagaagctgaagtcagggattaggattatccttggctgggagtggcaccttcttgactttctcacagaaagcacatttgaaacctgcaactggttggaatcaggggtgtctatgacatcattgcagatgtttgccccgttgttgactattagaatcttagaatgactctcccaagagagaaattgctgattggtttaatatattttgaattggaaaagaaccaactaggagacagtatacattagacctaatctcagacaactgacttgttttgtacttctgactggccacaaaatcttttcccaaaataccaccacaggaaggcattcagcacaaagagttttgtgaatcagtgacattctactattttgggtcaaatatttgtcaggaaactgaacacatctccagatgattgccacttatgtctcagcaaggaagtttattcagcgagtatcaatttgtctaaagacgtgtttccatcaaggtattctcttatacttaatcaacagtaggttactatcccaggcatcctttgaggaatcttcttaatctaaaatataattaaatactgagatgagcaactaagaataattttcaagactctctacctacatattttccagaagaggacaacttgacacttttccaggatgatttaaattatcacctatttataggcaagacaatgagctgaacgatctcttaaaattcttttcaacttcagagctaagagaaagctccaatataaaatactcacttgttactgacatgttctctgctcctatttcacactcttctactttattaacaaatataaagcccgctttgagtataattcagcaacattaataggcgtctggaaagcacattgcttacttagcttaatagtccccattttgagtactactgagaaagtacacaaatagagctctgaatttatagcaatgatctgaccacagccctatgccataaattcatatttacaatctgaccacaacactgagcagctacatgctcccaagggttggagaataattgcactatttaattatttttgagtcagttttgctctgtcccttatgagaagaccatctgttagactgtactgtactttgccctgtaccacatttccgaactaataaaatcagcgtcactcccattgtccctttccttgcaactcgatcttgtggcctgtgtgttttctataggtgtctgtagtgttttaactgctcagagagtggttctcccctttggtgtttcctcttatcttttatgttcactttgtttcccttaaagctgtcctactttattggtctggacagtaaagtcggagaggaggagatttgatgtggaaaaaccagagtgatcctccatcgacagggctcaggagtccatgagcagctagagcaggtctctcatccatcatcctgccacggagttccttgggctctttctttgtgtccccagtgcactcagctgtgatgaagtttttactgatcagaactgtagaaatgtctaataaatagttaaaggtaatagattttttaaattagggggctcagcttgtaagtaaggttttgcagttcttttaaacttcctcattttgtgatattattttgaaatattctgcagaacaagactttgaaaatgactttgtagaatctcaaaggcaccagctcctttaccccacccccacccccaaaaactgcaactaagaatatattccatatatcatatctggtagaactttgctttttaaaaattaattagaaaaacaattgcatttggaaaatgggtctaggcattcaagtacaacacaatcacatttgtgattttttttttggctaatacatcgaagatataaaagtgtcaaactactatgtataataacagtctaattatcttgcttcaaagggggtacatcattatattgcttgaacttgttatctgcctaccatccacctccttctttatgagtgatgtttaaacatgtctgatacattaaatgtttttggaaaacctggactagacttgaaagaatgttatgtcgatggagttttgatggttttgaaatatcgcttaaactgaatggctcaagatgtgcagtcatattaaatcaatgctgaaaagttacaactctaataaattgtatttatgctaatggttgagtctgatttactgcggccattaaaagtgaagaataggagcaatagtcttctcagaactgccattttccctattttctcttttattccttcacagctccacaaagtgtgccaactccctcaagagtccgcagcttaaatggatacagcattgaggtgacctgggatgaacctgttgtcagaggtgtaattgagaagtacattctgaaagcctatagtgaggacagcacccgtccaccccgcatgccctctgccagtgctgaatttgtcaatacaagcaacctcacaggtaaatgcaatcctttaacagagtagaccctattaacttcctttttgtttgcattttaaataaaaatcttctgcaaatgttttttagaaaaatgtattaaatatacatgtattttacctgattaaaaacaacacccatctaaagtagtggaagcctgcatctacctaggataaaaaggataattctacaatgcgcatgggctctcatggataattttattctaaggtagatattctctccatcccccaaagattacatcataggtggctatagccctttaacaccttatagacatcttttggaaatcctatgtataaatacttatttcacaaagcaaaaatttactctttgggactagccccagttcataccactattatttattgtaaaattgctgattaaacctaattatctcaaggtggaggagtcttagagccccagttagttggactggcaaatcagtgaatcgatttctcacagtgtggtgtgccatgaagaatgattataatgaaatatactcatacacaccactaacacatctcacactcaaattcatgcgtgtgtattaagagcatttttcagcttcatgaaatattaaagcacatttaaagggagagtttaatttaagcctttgataaaagggaagtaaatgtgtcaaatttgacagaaaaaaaacattttcctctatcaaaaaatcctataacgtgaaccatcagaatggacgttagaaaagccttaaatattttcccaacaaacctgttggtcaattccctcaagactttacttccttctttagacactttggaatgcacagcccaaatatactaccaacttttagcaaaagaaaaacaaattcacacccttcacttctttcctattttaccctccttatcaaagcccagcctgagtaagcccacagcttgccttttcacaggttgcatatggcagctacatgggctggaaaataccaagtagtttattgctaaaaatgctcaaccccactttcagatgagcactcagtaatgacaccaaccctactgtatttccagaatagctccttcccccattctcctcattaaatattttatatttttccaaactatacacgttacctccctttctcatcccactcagctgacagcgttctattttagattatattagacaccatagaaaaaacaatttattttataggatttctattactttcttactaccaaatgtacatattaattgcatttttctgcctgatggagttgttattaggggttggatgaatgaatgcatgctaaaacacataaaaccattttgatatacaggaggtgtgtgctatgctataattttattttcattattatttttaattttcacgctttttttcctttctgttttacaaagcttctcttatcctatcaaaaatagaaatcttcacaagtcctctggaccctgactctttctgtttcttcagagatattactgatagcttatcgtcctctcacttatatttttaacgcctctgtctgctgcagtagagtatggcccaaggaccagcattactagcttcacttgggaacttattactaatgcacattctcctgccctgcccaccccacacccgccaaatcagacactctgcagtgtggctcagcagtccttgttttaacaagcccccagatacatctgatgtatgccagcatttgagaaccactgactgggtggattcttcccagggtcattcaaactcttttatctcccattgttaaaaaccaacacactaacccaaaccaatcacaaaaatcttaattctgtccaaactcccagctattgctccctctctcctcctctcggccttcgtctagcatgaagtatctaagctcattttgtcctcacttaactggcttctgctcattactttcgtgacgagcaccaaaaactgccatgtttacataggcaaaaaacacttgacactctatgtcttcaccactcttcagcattctccacagtaactctttcatcatttctagaaatatttcttcacttctgtgacttttctgcttacctcctggttctccaggggccctgttctcagtgtcctttgctcacttcttctaaagtgtgacaaaatattgaagagtctcaggatttagaactgggccgtcttctctttctctttcatttttttctggcttgctccagaagccttattgactctcataacatcaaataccagatagatgctgctattgactcctaattgtacatcccacctagacatccaaatgcctgcatccaataggcgtttggacacaatgacatttccaactggatgtctctcaccttctacccataccaaacctcaactcttgcttctcctgcattctcatagatacctccagccacccagtcaatacaatttgagagttactctggacttttcacctccttcacacctcatatccacagttgtcattctatttttcaaaatatgtgttaaggtcatccatttctcctctaatctactggccagcccaaactactaccatctttttcctggacaactgcaatacttaccttcatctttttcatagccttttttttttttttctctccctggccgtgagtgtattctacagagcatccaacatcatgtccctctcctcaaaaactttctttcttttttttttaattatactttaagttctgggatacatgtgcagaatgtgcaggcttgttacataggtatacatgtgccagggtggcttgctgcccccatcaacccggcatctacattaggtatttctcctaatgctatctctcccctacacacaccctccaccgctcgacaggccccgatatgtgatgttcccctccctatgtccatgtgttctcattgttcaattcccacttatgagtgagaactcgcagtgtttggttttctgttcctgtgttagtttgctgagaatgatggcttctagcttcatccatgttcctgcacttcctctctcacaatcacactttgtctgggtctccccctacttccagggtttccaacaattaccgttgtaattaatataatttaaagaaatttgtatgtaaatccttaggagaattcctgacaatgatgatataataaatccctagcagtggaataactgcatcgaaggcttttaagacattgtatagtcttgaactttgaagtcagacattgatataaatctctgctatataccttccctgtggataagttccacatccttctggatcctaaagtcctaacctatgaaatgggagagtgatatttacctcagaagaatattgaaaatattaagtgatatgatattctagctctaaccctttttagctgtgtagcttggacaaatcaataaacctctgtttgctttaaaatccttctaggtaaataagaatgagatacaactacatgcctcccagggcagctgtggggattaaacgaattcatatgtatgtaaagcacatagcacagtgcttgacatgtggcatgcactgtatcaaagttacctacaggatatctgtaaagtgtgtaacattatgcttaatgcttggtaatttctcaagaaatggatagcaattattattattattattactattattatttaatgaagtctcactctgtcgcccaggctgtagtgcagtggcgcaatctctgctcactgcaagctccgcctcccaggtttacgccattctcttgcctcagcctccccagtagctgggactacagacctccacgcccgggtaattttttttgtatttttagtggagacagggtttcaccatgttagccaggatggtctcgatttcctgacctcgtgattcacccaccttggcctcccaaagtgctgggattacaggcgtgagccacagtgcccggccaggatagcaatttttacactgcccaaaaagctgtacaaattatgcttccaccagcaagcagaatgcaagattgtgcatttcattttatctagccaacaccaaggtttacacttgaaaaaaattgcaaatttaaaaggcaaaatatatcagaatattgttttagtttgtatttatgtgattactagagagattagttttttaatatttattgaccatttctacttcttttatgatgtgcctaggtaggtccattgttttttattttttattttattttatttttttattttttgagacagggtctcactctgtcacccaggttggagtgcagtggtgcaatctcagctcactgcaaactctgcctcctgagttcaagagattttcctgccttggcctcccaagtagctgggatttcaggtgtgcatcaccacgccagggtaacttttgtatttttagtagagatggagtttcaccatgttggccaggctggtctcgaactcctgacctcaggtgatccaccagccttggcctcccaaagttctgggattacaggcatgagccactgcacccagctgcattgctaatttttctattgaatgattcacattttctcattaaagtttttctctgcatatgaagaataatatacatgtttatctcatctaatgcaactcccccagttttgtcattttttaaaaaattttgatttgcatttttgtgtagagatttaaaaaatattttatgtagttaatataacacccttaaaatgttcaatattctatgtgtgattttttaaaaatatatattccccatttagggttgattattgtttatgttagatataccatattgataacatataatgcatattcctcaaaatagtaattctaaggttaggataagaacaaatcagaaactggatgcagggaggcttttcaaattaaatcagcctctcccaagattctgaaggataccttcttgaaggcgagatcccacagattgtaaaccaatgtagggcagtactggatgttactcaaaaggcatgtcatacatggtagtgatgtatagggagaagaaaatcagaaaactgttgagcaattgttatttatttttatatatcaaatttgtcacaaactaagggaagagttaactatgttaactatgcatgcagttttgtcaatttctctgagatttttttgtttgaattttttgagtttttattacttttacacttattatttatgttttaaccttcaaagtctcattgctttaggtacagtcatgcattgctaaaggatggatatgttctgagaaatgtgtcattaggagatttcatcaccttgcaatgtgcttacataaacctagatgacatagcctactccacacctaggctagatggtgtagcctattgttcctgggctgcaaacctgcacagcatgttactctattgaatagtgtagggaactataactcaatggtaagtatttgtgtatctaaacagatcaaaacacagaaaaggtatagtaaaaacactgcatggtaatcttatgggaccaccatcctatatgttgtctgttgttgaccaaaacattatgtagcacatgaccacatggcagcaacttggctaacatcctttaattcaacattgttttcttataagtttgatgagaaaattaaaaaaaaaaaaacaatccctagcaagggccactctctgcatggaattttcacattttccccatgtttttgtgggttttctctgggtactccagtttcctctcacatcccaaaggttttccccttacatgaattgagttgtctacgtgaccccagagtgagtgagtgcaggtgtgtatgagtatgccctgtgatggtatggtggcctgtccagggctgattcctaccttgagccctgagctgccaggatgggctccagccacccacaaccctaaagtggaataagcagattggaaaataaatgaatgagtaaatagaaatcattataaaataaaaattcataaagtctatgataatcatacagatgcacagcaataaacaattcagtatgacagggctcagcaagctgcccagtctgtgattgctggggtttgaacttcatgctggtaggcggtgctccttacaatgttcacttggaaagcatttattccttgatttatataccacaccactgtcactcactgattcaccaaaacttgagtaaatcattatttcgttttgattaatcttttgtaaatgcatgtatagcacacattcatttcaatgtttaatattagtagtctatagaaatttggtgatgttttgtgaccagaaatatgccataggatcttaattcttttttacatcaattagcctgtgggaaaattgggtttgttgtatatcatttcacttaaaagtgatagtttacaaaaaattccaatgacattaagtgaagacttctatatatctctgcagttttagttttatctttcacttgagattctctgtatttaagtacgggagtcactcattcatacttgtttttataattgatataattggtcttctctctgccatcatgttttatgctttccagttttattatttcttgttttttagtgattttttcactacatttcttgccaatgtgtactatgaattctttgattttttttctttcaaggagtttgcttctctcaatgctaaattgagtcatcaaggacataggtagaaggtaatcttaaagactaagaagaactccagtattgccaggtggacttttcattgtgaagactcaggataatgaggagggaatgtgaattgagagtcaccaaagccagcttggataattatcaaagtcagagaatttcccagtaaacaaaaggaatactaggaagtgagatggaaggagctgataaagcagagagccagaaagctggatttggtggagacgttaggggtgcagagattgttttgaggcagctgttttgccagttggttgagaaaccaaggtaccaaaagagagaaaaatcggtgaagcctatataaacagttttgctattgagcagttttgctactgatcttgaaaataacccttatttagcatttctgaggtgacttttgttgagattttaatatttaagttaattttggttgttagagtcatatttaaataaaataattctgacactgaatgtacaaggcaatttcgctttattagttagcgtagggttctttaccaattaagtttaaaaaatgctaatcagaaaatgtgctgttttatttcattaattttttgttgtataataagctcttttattcttcagatttgggtctttcttcagcttggaaaatttgccattgtgtttatgatcattacttctggtgagaaatagcaattttcaatattgtatatttcttcctaggttgtcttcctcattttagtagttcagaacacggcttgtagagtcaaatcaatctaaggtcaaattccgcctatgccactttttagctgtgtgatctcagacaaatttaaaaacatatccttacattggagtttcctcattcataaattggggatgaaaaccttatttatattatggaactgctataaagattaaaatgagttatgtaaaatattttgctcagaaacaggcacatagtgagtgttcaatgaattcatagttacctttataatctctgaattacagtttctgatttctgggttattgtcccataattgtttttatttccattttctgatttttgcactgttgattctgctctttgaaacttctaagatgatttttaattcttctagttcagtctttgatatgatctgcctttttcctcatctagcttgctttgatttctgcctgcctcttgaaattctcaatttttgtcttcatctcttgtttactgcttaccttctgtctcttacttagtggattccaagttattttagatctaattaatggcatgcaactcgtgatttttaaattttacaagtttcttgaattaaatcctccccagaatatgacaatcttccataatttgagggctatatccttatccttctttcaagttacaatttttccatcagctaaatgtcctcccccaaactcaactccatagtttagttggctcatctctaatataaccttctgactgggtgtttgcatgggaaaattaaactgttttcaaatcatcttactgggcatccagttgctgttaataaaagcctttgctaagatgatgacagggttagtggggtaagtttgcattagccgcgcagccaccctacagtttcagcttctttcttcccagtgtttggtagagtaggagtgctgagagcttgctggcattttgcttccagtttaagtttgggtttgcctaggactttccttctaacagtccattgtctctgcctggtctcgttttaggtatttataaaactttggtcgtttcactgggattcttacaaggtggtagttcaaaactatagctgtatactgagtcaactggggagctttaaaaaatatactgatggctgtgtgccccacatgcaaaatgtctgattaaattggcctggaatgtggcctggacatttgtacttttaaattatctcaggtaattctgctgtacagccagcacagggaaactctatttaaaggaggagtttgtcaccagtgatcacatttaaattttatccagatattcttataactttcatttccccactgaaactcaaaaatgttaggaaataaaaaactaaatgtatataaaaaataataagctattaaaagtaaatagaaaatactagcaaaggaatatcataagatgacaaaaattaagtgtaatagttattgggaagtgggattttatgttcagacttacaaaaagcagaaggtaaaagcaaagaaaattattaaaaatgaatatcaactaagataactgaagaaaacagaatagtgaagcagaatatttaccattcatgaatttgtctatcagaggattaaatgagataaatcccagttgcaatggagagtccaagggttaacaggcccgctcaggagcaaatgggcccctttgggccacagggtctagattctgtgccctcccaaggccaaggttcagagcaaggagttctttaaggttcattccctcagccagagcctcagggtagaaaacccttcagttatcactcctgtgtatctttagatttgttgaaagggctccaattaactctgggtagcttttgctgatttttcctgcagccctgttaacatgcaaagctgcagcccagagagacaggactggcgtttcccctcaaactgaggactgctcagaaactgacttcataatttgatttgaaattatttcaagaatgaatggattcaagacttcgcacatatacgaattattttttccgtaaggtgtttaaacatgtaaacttaattatcagcataattactacagcacctggcatcaagtgttacagatataattggtgtatacaaaatattttctcaattttattgttgcattacattgagctaaagtctaggggttatattgcttcttcaggtaaaatgataaataatagtaatatttcttactatttgctatagtttggcaaatgaatcaataatgataagaataatcttccagatgactcacatatatctacatttatgtaaagaaaaagacattttaatttataacacaaataataatatagcttttgccactaaaattgtttcagtctttacatacaatggacttaatttttttacctgaatgaagtgggtttcatactgaaaatctgcctctaatttttgcctcttttacatggctactgtaataattagtgactctcaattctactggtcataaggtgattctcagattacttataaaatgcagatttgggggtcactcacacatgattctgtacatctgggctagtatttagcaatttgcattttacctaatgctccaattgtatttttggaaggtttatgaaccacatattgaaagacactagtgtagaggagtggtcagcttagactggaatactttcacctgctaggcttgcaactatccctgctttattcctgcttctggttctgactgtgttagctttgctgccagaaaaatgccaaggcaagtgaagaaagagaggcagtgtcagtaggacccctgaaccccagtaggactcctgaacttctgaaaattcccagaagaaagaaagtaagaattggggatcttgataacatggattctgattcactaggtctgggaatatggtgttagattctgcatttccaaccagccccctcccactctgtcatgccccatatagaaaggcaaggagctcactatttatatgggaaatggaaaacaacaacaacaacaacaaagaaaaaacagtaaaataaaacaaaacccaattctcaattacaagatgccccttaggttcatataaaagtgagagcagtataattcaatgtaggaattatcattgcaatgtcttggtagagccttgcctgcatgcatttaagttacaaacattcaactacatattttggaaatgggtaagggatggaggaaaaagtaaaaaagcaaaaattaaacaaaacaaaaacctataaaaatagtgtcataggcaaaggatgctatccagtatggaaaatgtcaacatctgttagctggaaagaatgtttgaataattttagggtttcccagtcattgacaaagaagtgatactcattgtttgggtgtctacaaaaagaatgaagacttcagagccctgaagaatcattgatttctgaagagttagaggcatacacaaaaccaaatgtactatactttatgggccatataaagagttgtcaagggaactttaaatcacgttatttttgccttatgcctgattttggaacttaaactcagctatgcagagtatcatcagtaagattaaattaaattaaaatgctactctatatatgtatgtatatgtgtatgttatgtacgttcatatattatataaatatgctctctctctatatatgtattctctctatatatatgtaaccatacttacctgagaagtctgcagagaaatgactgtaattcaacgccgtgaaatttttttttctattcaactgaaagttcttactccatagttgctaaaactgcctatggtactctctgtgcacccatgctatttcttcaatagacaataagctcctggaggacaagtttcatgtttcatatttattttaagcctcgttcactaccttgctcaaggtaagtgattaatatacttatcttaaaagaatgaatgaaggaatctttcaattagcaaatgtagctttctgctactaaccccatagttaacctaatgttaatatttttttgtgctgagttggactgagtattgaactactagtccttactaaagtctcctcagtcttttatcaacagttctttaattttatagaagaatgcacagagctatcacaacttaaatgtatatttggaacttaatacacatttcccaatagaaaaaaaatatgttggtagggtaagactaataaataactaataaagactaattccaaaacttagacctcagaatagaacccaaccactacatatttgaaatgaaaaataatggaagccaatactgctgcaatgctgataattataaagaacagaaaatattcatttatttaaaaaagtgatctaccacgttccatgctagtgctaggccctatcattgtaacatgatttttataacactaaaatatagcccaagcactctctctgaagtataagattatgtagacaatgaaagttttatagggaaaacctaacagagatgggtttatcatttttaattcattatttcacttgagatactgagaacctaaaataatagcgatgaagtttttctctcactggtaataggtgtccacagtaagtcaatgcagaggcgggatgttcataggcgagacccacacacttcatctttttgctgtgtcatccttatggacaaggcttctacctcatagttcaagatgactgcttgagctcctgccatccagtctgattttcacccaacaggaagaaataatggttaaagaatactcacattcactttaaagacatattttagaagttgttcctccacctctggttatcttgcgtggccagaacttagtcacatggctgtacctagcttcagggaatgttgaaaaatgctgtctttattccaagtagccacttgcccaggtaaaaagtgtttttattttactgaggaaaaggagtataatacataataaggagcaattagtaatctttgccacaataggaaatcgtcagaagtaaataaaaagtaattctttttgttggtgttattaaagataaaagccagtttttatagtagaccataaattaatattccaatatttgtagtttattacgaacttttttttttaatttgagatggaatcttgctctgttgccgaggctggagtgcattggcaccatctcagctcactgcaacctgcgccgcccgggttcaagcaattctcctgtctcagcttcccaagtagctgggactacaggtgcatgccaacacatctgttttttgttttttgttttttttgtttttgtttttgttgttggtatttttagtagagatgggatttcactatattggtcaggctgatctcaaactcctgacctcaggtgatccacctgcttcagcctcccaaagtgctggcattacaggctacaaaatatttctttaaatgtaaatcttgaaagaaactggtctgaaaaaattcacaggacgaaaatatggcctatgacataaatagtaaaaatagaaatgatgtaatgttcctgcttagctaatgtagaaagatttcattaggtaatgcagtgttgatgagttaatagctttgtctaactctcctgaatacataatgtgcctgaactactggtacattgtgaaatcttcagagagagttgttttttaaaaaaaaaagtttttcattttattttatgcaataagaattgacaccaaaggatttgcatttctttttggtaacatgttgagccgtagttaaaaatgatgaaaatatataacttttgttctacagtgataatcaactaggcatgtccacaatgcttataaacattcaatacaaatacttcaaggttatcaatcatagttgataaagaagaagaatgcacagccagacttttctgttttctaccttttatgatcattttatatttgtgttatatttggaacaaattaaaagggttatatgtataataaacaaaggtccaatattgaacccaatctctctctctcacacacacacacacacacacaaatgcacacatagaatttcttataaatcagtcatttttgtaaaggaatattacaggcatacaaacttgctcattttggaggacaagacttctaatttctgtttgtaagcaataggtgtcagtaataaatttgaacctcttaacacattttaaggtgcattttaaataagatattttatagtaaaaagtgtgctattattgtttttaattaccatttttcaacacttttttcttgtttgtggaactggagcttaggtcaaatgggaggagtaatgatcttggggtcagaatacaggttctaatattggctctactgctttttagctgtctggacttgagcaccatacagtacactcactccaaaagcagcctcctctgtacaatggaataacaatatcagaggcttgtagcaggggaccttggacactgatcataagggatgactttcatttctctttcttttcttttcctcttgtctccttgcctgtctctctgcttagtcaggtccagtgttttcttgaagagtttcagtaatttcagtgtgagacctttatgtaaggtaaagagttaacacaagcacgtggcttcaaacttattggcaaattagaataaaaatggcaaagactctgtagttcttaccacaaaggcattgattaaaaatttgaggttagaggtaaacctgctgagagaatcttaactggataatactttgaggtcaattaaaatcactgtttaaaccgtcctctaagactgggattagaccacatattttataaagaaataaagaataatgtttttcctgtttgtaagaatcaacatctgcatagtctttgataggtatatgatattctatgctctctaccaaaagttttaaacaaggtcaaaaaacccatttgaaggaaattaaatgtaagaaaaattagttttgaagtttccaagggattaccttaggtttgggttaagtgtatttattgttccaccttttgggtaaaatgcaaattgactttccctttgtaaatattagaagtccttatttttattgaaaatattatccaaaaacaacaataacaaatcccaccctcctgggctaagaaccagaggagaagcatcctggatatgtttccagatctctattagatagttaagttttcatccatatttaacaaatgtcattattcagtttcatgggatcactgtgtcaaaatgtctgtgttagaactttattttcagaggttcctttaagtggtcaggaagcatggcatattggattgattactctctttaatccatccactgggttggtttgggatgtatacttaaaaattagattttatcagcactgcagcgggatcctcagccagaagtctcttcttctgccctccttcccctagccagttttcttttaaaaagtgggctcttccattatgtctccaggtagcagtagcagctctgcctgtgtggcatcccttaccagatggccctcttaataaatgtcttgctcttgcccaccctcactttcttgatccaaatgtgaaatgccagcaaataaataagagcattgtactctgatgagttctcttgagatgggggaaaaccctggggagaggaagctagaaacagcttttctgtttgctgtgactgctcctaattactggccagtagtagaagatatcatttagatgcagtagaatataaagataaagaaaaaaaaatgagagataaattctccatgttatcccaaatgcctttgctaacgtggaaatactcttggattgttggagtgcatttgaaatattgtgcatgatccttacaaggggacccctgactttggactcagggtagacagttgctgcatgcagatttcaccgccagactaaaagtgcaacggaaatgagtgggtgatgagagcagagcagccagttctttaattgaattaaaagctgggtgacatcaatgcagacacctgtccaattacagacaggccaaggtgtttaccattgctgtacaagcgattcgaagatgacagaaatctttccgcccacagattaacataatgaaggagaacagattacagtggatgccggccaaacaccttggttggcagctgggggtggggtgggggagggaggaggagtctgctgaagtatgtaagtagaaacggagtccttttttcttctctgaaatatgctcggctttaaaaaggatccattttgctttgtgtcttaggctcggtttccaggcagagcatttatacttgtctgcatttagtcagaggagttaatcataaaatttcaacgtgaaagcagactcctctgttgttttgctgcttctcagcatacggtgtcccattagaggtgcaaaagcttgcagagctggtgtcagctccacaatgattttgtcttaggtcgtcaggctgcctccaattattaatatttttctttggctcctttgaaacttgaggttacagcaaaggaaagagagtgttggagataataatgtatcagtcaaaagaaacaatgtctgtcactttgcttgttccctggaaggggcgtggtgggagtcaggctctcctatagtgagagaaatagccgagtggagctaacagtctgcaaaatcttaattttcagtcacccgtcaagtgctaacttttggtaaaccatactaatagctgctgggatagaggataaggaaagcagtaaaaggctatgccctctgtgttcaaggaattcccaaatcactgtgaaggacttctaagttgcaagttctctaggccaatgctcttcccctctgttaagtggaaaccctgagtgcacagagtttggagccatatgcagtaggcctcttaacctatctacggtgatgagtttccttcccttaaatcaagtccctgccccctgatctttcagcttgggctttctgcacccactgtggcccacaggacttcaattcaaagggaatctacttacttgacttcaaactcccttggtgtggcatgtcaggatttctcaatgttaggcattaatgcaaaatgcattatcgcttagcagtgagagttatggtcctgctggtgccaatgattttaatccggatacccacgctcctgtgtttcatgggatactaacacttttaagacatcaataatgcttactttatgcttattgaatgtttcttcagcttgccctcttccattacctagagggactagcaggtttcctgacatgattgggaccattttctgatttcacagagtttgtggctgaaaggcagtttgcgaggtcatctggcctgccttgtaatagggacactctcaaaaaaaaaaaaaaaaaaaagacttctctgggatgtgtcccaaacaaagagattcacaaccaaaccaattttaaagttctccctttcaggatatacttcttcagtataaaaaccccaagtgtcacaagtatcataaaaggcaactaccgcattttctatttttgggctttctgtctaggattcctttagatatgtcaattctctatttcccagtattctttttaatataataccaaaatatatatttaaattaaatttaggcttcctattatcttgaactggtaagtctgaatcttataaatgtcattgtctacttggcccgtatgcaaacattcttctttatgtatcaatctgttactgtaagaattcttctagttccaatattttcttatgttagaaaccttgtaaaaatcagttgtattctatagcaccttttccagacgcatatagcggaaacattgataaatgctttttgatgatgatatatcttcagagtaacactgtattttccagagagtacctaatctaagtagaaccctgacacttaaagcaaagccattaggataaccactcaatgatctcaaaggatatatccacaatctacatagtcttggagagaatgtgttactctctttctttggccatggcacaacttttcaacttgaatccatcctggtgaacactacttactgagaatcaaaggagataaaccacgtgtctccaacaataaaatgaccttgtcttgattccaagtgaatgaagaccacatatttgaccagccccttgcccttgcataacccttaatttttaacctgacaggaggagaaagcacagtgaaccattatagtgttcttcttcctgaagtaggtaattctaactgcctttaaggaaaattatcagttggtttgacaaactttgtctctgacacacagcatgatgaacaagattccctactggaaatagaaaagaaatggcactccagccttagaaaatgcagcacattttttgaaagtgtgatttacaagccatctaaaaccttccatctttgatccaaagttggcaagaaccaaaacatcagctttcttctttttctttctttttttttttttttcctttgttttctatttttcagctctcatttctcagggcttattattgtttcaccgggcttgaaatgggaaatgtgagcactttgataaatggcttgaaagatgatctagtttctctccagcatctttctttaagagtctcagggtttttctatgaaatacaatacaatttggtaaagatctctaccaaatcaaagctgaagaagcaagtttgctgagatgagcagtgcttgcttttaaggtccttaaaataaggagtggctaaaattaataaaagactctcactatacacatgttatacacaacgtaactcctttagtgaagacaagaaacattaaataaaacactaaagatcacttagtgagttgtgaactcaggatctggtttgatacaatccctctgaaagtctatagaatacccttccttataacttgatgtaacaattaaaatttcaacatttcactctagttatgatttggaaagaaatgtcttagtataaggaattttataaagccaggctgtaaaattgtacaatcatagagctgcttttatatttctcaatgataatacttcctgaatgtacaacacatcttcatgctaatgattgcagataaccaacctgtatatcagcattgtttctttttgggcatggtgttcctatgcctcagctgaagcatgctcatctatgaagggtgctgcttttcacatatgccccataggttaagtgatgataaagggaaactagcctcatattccaacatgcttttccttattgacattaggattaaaagtcttattctctgggggctgattcatttcttgttagcatggcgttatactaattcagccatgcaagtcatcttatttagaatcttacggtagtttccaacttggcaataggaaagacatggcaaatgccaaagatttgctaaagatagaatggctaaaacacattttatgatgataactttagttttgagcctggaatttgggtatcgtggtggaggcattacaaaatggaaaaatgaagcttacataattatttagaatgttgattcttggttggggcacgttgagtatgaaataccagtgggacatccaggtgtggttacatggcctgcagatagaaacccagaaccagggcttgggagagatgtgaagtctgtagatacaaatgtgatcactgaaagataaggcttaataagctagcaaaggcgagtgtttagaaaaagaaagaagcttgacaacaacccaatcttgagaaacaaaagctatttaagagactgtgagaggaacatgagtcagtaaaggaaacaaaggagttctcggtagtttaggagaacaactaaaaagttcaatgtcacagaaggaagttgagggaggataaggactgaggaagggctatttgatttggtatttaagggatcactgctgatctttaaaagatacaaagcgtcggccggccgggcacagtggctcacgcctgtaatcccagcactttgggaggccgaggcgggtggatcacgaggtcaggagatcgagaccatcctggctaacacggtgaaaccccatctctactaaaaatacaaaaaaattagccgggcgtggtggcgggcgcctgtagtcccagctactgtggaggctgaggcaggagaatggctccaacccgggaggcagagcttgcagtgagccgagatcgcaccacagcactccagcctgggcaactgagcgagactctgtctcaaaaaaaaaaaaaaaaaagaaagaaagaaagaaagaaagaaagaaagaaagaaagaaagaaaaagatacaaattgtctagtagcatgtagaggcagaaactgagttgcaatggtagcctaaattggaatggcatagctctgcactagagctcttgactggcaatactccatgtaagtattctaaagtcctgaacttgttcagtcttaatactaaccctttgaggtaagtactatattatccccatctcacatgtgaggcctgcaaggcctttccttcaagaccgagattattattatctgtttacagactaggaaactaaggcacagaagtctgaacaacttgcccatgtacatatggccaatcggcagcagatttggcatttggagccagcaatctggcttgagcatgggtgcccatttccccactactccattatgaagatgtgcatgtgataatgttagcttgcttttaagccatttggtggaaggagaaataacttcttaaaagaaagtaaactcagaacgtaggtcatgatctgggagatttaacaggaaatgacaatcgcaggggcaggaatgagagaaagcaggaggttctgacacgagagggttttgaaattagagagagctgaatttggcatgagatggtcacacatgtgtgtatattagttcgttggcttgctgtcttctttggccatgagctaagatgacggtgccaagtggatgaatattttcatgtagaagcatggcagacaggattcagtagcccacggagatgcctgggtcgttgctggaatgaagacttagagacagccctaggaactaagggcaagtgggaggtgtcaaagcaaagaactggtctttgctccatcctggcttgttgatcttttaattctttaaattttctactggggagggaaattatggaaacatgtatattaaaatttgtgtttgaatgatgaaagctgtcatcaaaattggcaccttaaagcaataatgtattctctgagcgattgaaggtttcatcaataaagagacaccacgagtggggccatctttttataaaaatagtcataatctatgtggttaggattaaagattgctctgaaaaacgtctttgcggaaaaacagtggtgagcaaaagcacaagttatattttggattttttttaattcacaggattaactaaataaggagtctctgccttgcttatgaacactagtaaacaaaatgtgttttcatttctacacatacttttaattgctgaacaaatctcatatatctaccagcaagccatgttaattcaatacttccacgtgtaacacttccgtttaagacaggtgtcttaattaaataaactaataattttgcaagtagaagtacaaaagcataattatctaatttgctaattgttcaactatgttaatttgcatacttgttagctacaacataaacaaatggtttgtatatgtatcgcctactgttaaaataatgaagccactcttgggagtagcatttttaaagtgtgttaataggtgccctataaaaaggactccttagttaaatacggttgaaaaatgctaggttaaagaaaattaaatagttttgtttctgcaggaggtctaggatcctggaatgagataatatatatcttagctattggaaacattgtgctctgcctcacgaactatatgtggaaccccctccccattttaatgggagaaacatcagatgctgtttgagagctgttttaacaataagttggtctcacaattttttctcatgagtccttccattcaacaatcagcagaaagggaggaaaatgactgaaagaggaatatgtttttgatttctgtctctggtctctttgtttttgtctctctctcttatagacacacacacagatatacacacaatgctctttattgatgcttatggtaaacacgcaaccctcttttgtccctttttattataggcatattgacaggcttgctacccttcaaaaactatgcagtaaccctaactgcttgcactttggctggctgtactgagagctcacatgcattgaacatctctactccacaagaaggtaaagtaatttcaaaggtcttgacttccacatttcagtcatgaataataaaataggagaagagctaaatgctacaaggccatttgctggcaaaccccaacctaatttgatgacaaagtgcattgccaggccataattgctccattttttgggggggtgcgaaaatgaatcaaactccataccctttaatgacatgcatctttaatagctgtaatgcagattaatgggctttttaattgctgttacattgttcatgcaagagccttgtcattaatatgaagcatctgaaagattaatgaaagcttcctcattttactatggctcagaagtaaatctagagacagtctgactaaaaagaattgattgtatggcacagtatgaaattgagaatcaaacggttgatttccatggtcttttttaactgctaaacagcagcacaggcaacaattatttcagtatgatgaaacctccaaatgccaattgaggcattattaatcactgcttagttccttccaacttaagtctcacttctgttgtacttggaacttacaaactgttggcataaattaaggtttcagaaagcatatgttaagaaggcagtgagaaagagaaaatattttagcacgccaaagtgaaagctttgctcaagcatcagaatgcatcacttcaagaaataacagctctcaaaacatttgaagcattgttacttcatatttctctattctggataagaggaattgtacatatcttatactgtctagttgaaaagttctttaggagatttaaacgcttgatctttagggaaaaagagtcagccagtctttctctctctctctttcccagtatctatatattccccccttcctcttttaaaccctttaccaagcaccacttgcactgaagatatgtaacagaaaggaagacatggacccataggatgaaaccaggacaggataaatgactttgtaaaatccttcttgtgacccttaatatgctgtattttttacctaaaccaatcagactcccctcacctgaactatgctgtcagtgacccagcctcagcattttctccatctggtctactggtaatagcactgtttttgttgtatcattgcatctgctgaggacatgattatcatcccctcttacaaggactttgaccagcctcaatatgggacaaatggccctatgttgcattattttctccgtatccactaaatcctttgtccagggtttacctggtacccttcataccaatttcaagctaagccccagagagatccctgctcttgtttatatttccttttttatttttaaagacattcccaaacttctaaatatccacgaagtaattctgaatttactaaatgatagaggagtttaggaaaatttaaaaaaaatgtttagttcttaggaccccccaattcattgacaactatataaaatacacagctctttttaaaaaaatatgcactaaagttttcatatgtaattgactaatttggttatgcgagctctggcaattcttatcattacatataggtttttaaaaatttatattatgaaccacattcaccagcattactcatctcagatcacaagctccttgaggctaggggactctatctgcttaatttgctttaataggtacagtcccacatagagattatgggttaatagtacttttggtggagtaacacaagcatcagtcaagtgaactagtgtaagtactcctcatccatcattgacacaaattctcataaatgtgggacagttatttaacactgttcctaaagcaattactgacaagctgcccacgaatcgggaatatttccatgcatgggatttcaggtttattccatgatttattggtttgggtctgaaaagtttgaattagaaaagtaaactaaaattagactctataaatcttttcttccacagccccacaagaggttcagccaccagtagccaaatcccttcccagttctttgctgctctcctggaacccacccaaaaaggcaaatggtattataactcagtactgtttatacatggatgggaggctgatctattcaggcagtgaggagaactacatagtcacaggtaagacctctagagttatcagcgaattgttatagtctatattcaaatataaacatacatatagttggctctcgatatccaggggttccatatctgcaaatttaatcaagaatgcttaggaaatatgtgaaaaaaataacaacagaacaattaaaaataatataaattctaaaaacatagtataacaactatttacatagcatttacattgtattaggtattctaaggaatctagagatgatttaaagcatacaggaggatgtggatagcctatatgcaaataatacaccacattgtaacagggacttgagcatccatgaattttggtatcagtagagggtcctggaaccaatctctcactgatattgaggagtgactgcacacacacacacacacacacacacacacacacacacacacacaccagataaatagagtctatagttatctgaaaatgtgtttttgaaattgggttgcttatttttatctcctgttaatcactccaattgtatgatcttgaaggtcatattagattcatggtgaaactgaagctaaaaaaatatggaaaagtgctcatgttacctccctccacccagggctgtcctactgtgtgttctcttctatagagcccaccaccccttacctaaatccttctagcaattacctttgctcagatgcagaggaggcctggaaatgcacaaatgtgctaagcacaaagagctcagcacatgacttctctgacttcagcagaccacaaggattgaaattgggagccagtgttttcccagtcaggctcacagtgtccagttggatcaatgacatcatcaaataaatgcctctctcacatgagctattagagtggtgcaaaagtagttgtggtttttgccattgacagtaattacttctgtaccacacgaatactttaaaatcctcactaatgtgtaatagtcttaagactcagaagtgtgactcagtgtggtttgaattttagatcttagaggaaacatagtatatctgcccatatcatattataaagtgtgatgatactgaaattaaatgaagtaaattcttgaaaaactttctaaatacagaagacttgcattatgtatgctgcctgtactgtgtttatatttgtattatacttatagtggttttgtatttcatattattttatatactgtatgtgactctcatgtgagacattattaatcaaatgttgactgatgaaaaaaccaaggcctagagatattaacttcttcataaaggtcataacaagttagagtcagaggtaggatgaattatttatgtattcactcactcacattaatgccaggtactaaggttgtaatagggaactggccagatactgtccctcttctcttggtgctcacagcttcatgggggcacatgtagatgctggagcaagtcgtgtggacagggctgtgtattcatccagttgcattctcaggtttacatttttttggcccccctctagtctgagaaccttaaaaggacaagaacaattacttttatattttattattcataattggatagaattccataatatttattctacaacataggtattattttacaccccaattttacaagtgaagaaactgagggaaagaaggattaagtaacccaaggtcacacagcttgagtcggaggctttggtactaacccaagcattccggctgtgttgaagaatgtggtcttaaaaacaagtgttttaacttgtcttagtttctgaatttgtaaaatggtgttaattacattttccagtattttaaagagaattagaactatatataaaatataacatgtcattagcaattggtaaagagaagttataattgttatctcctgtacaacacagagttcattgtaaaaactgaataggttaatcttactccaacagtatcttatggcatgattttaactaaaaattataaaccacagaagttatttcagaaaaaattaaatcacaccatggaaggaactttacatatattacatctttgaacctttacatatattacatttttacatatattacatctttgatgtaacatattaataattaacatacaaagcacttctgtgaccaagaggtaacattgcatgtaatgggatatcataacttttagaaccagaatagacatgtcctctgagaatccttttgctccccacgtgtgacacaggtatgccccgtatgcttactgattacctttatattacatcgctgctttttgtttgtgtcatcttgaataggactgtttgtttgttcatcggtttgccctgctgaaccataatgatcattaaggacacaactatatttgtttttttcattactgcatctcttggacctatcacagagtgggaatggaataaaaagtgttagagtgaaagaatgaagtcagatgattcctgggaataaaaacaagaagatagcaaaggggaactgatggaggataggattagggtaggaataaggcaatagagaagagagaaaaatggaaaagatacagccaggggaagagaaactaagaccccttccatgcgcctaaacgaaagctgcatcagtccacagggaagtggtgcagctaatggcaggtctcaaactgtgggccttgactctttccaaaatgtacagaactccatatgaggttacactggacaaaaccggaaaaagggcagtgtagggagaggaggaagaattcacatcaatttctaataccacctgcaaaatgacactgaattctgtattttgtttgtttgaattatcaagaacgccatgtgactataggccctgaagaaagattgtggtaaatggcaccatagtgtattattacaatagaagccccaaatataaagaaagtgaaatatttttaaagtgcctacatccatggtaatagattgattcttcaatggttttctatctttatgtaatattttaaagaatatatctccaatactacccatagcatttttttttctgctgtagctttcttggcatttcataagcaactatgttccttgttgctttcatctccaaatagtttaagatatgaagcatattgggactgcaatgctggtcaaggaggggaaataaactgagaaagttaatatggggttcaaagatgcacatgattattctaactttatagctagaaaaactgagacctagatgggttaagaaactctagtcagtaatcagaggaactaattcaaatgtagatctgtctggccccaaatcctctgcttttaatttctatacattctgcttgttgctcatattttattttcccttgccagaactctaaaagaaagaccccagaacacctgtattagtctgctagggctgccatgtcaaaataacaaaactgggtgactttaatagaaaagtatttctcacagtctggaggctgaaagtccgagaccaagatgttggcaagcttgatttgtcctgagtctctttccgtggcttgcagatagtggcctcctcactgtaggtgcacatggactttctttcaggtgacttcatccttggtattttttcctcttcctctgaggatgccagtcctattggatgaggttcccactcttacgaccacagattttatatcagtgatatggactaagttcaggtcatttatatttttaaagtttagctatctacagagactctcagagaagactaaataggaaagggactctgtctgtctgaagtcagcaagggagaaggctgtggagaaactgatctagccattgggatgggctttagcttctatgggcagtttaagtctacaccataacatgtatctatctacaatgctattggtacttactgcttgtctttgtgtcagggtatttgtgacatagtatcttttccacactgagtggcttgtgggtagaacttctattcatgatgtctggtgatttcaataatagtgtcagtttaggtctactaaagtggatctgtatagagctgaaatatctcttcatagagaaaccgagaagtggaatacagagtttactagatagggaaaataattgataatatctttaattataaaagtgataaattcttacagaagataatttaaaacatgcagacaagtaatacctgagaatcctgtcatattgaaactcataatatttgatggaattccttctactactttattcatgttaacaaaattgagctataacctatgtatgatattgaatacatattcccttattatattatgactatatcctatcattaaacatttttgtaaaaatattttgaaatgttttgaataacattatattccatctcatatagcatataatggatatttattaatgcatttaaccatttgagcaatagtatctaatctatctctattttaaatatcttgacatagatattcttatacataaatctttatttgctaggttcctagaagaatagctaaatcaaaggtaatgaacatttgcagaatgtttggtatagtttgtcacattattccaggaaagttgtcagcagtgaattttatattcttaaatatttgattattttacaaaaaaaaaagttattttattttaatttgcattttaaagtactagttatagtgaatacttttctgaataattattaaccttttatattttcctttcattcatctaatcacattcttgatgagcaaaaatttaattggggtaaggaataattttgagacttctccacgagctatcctgttttttctggttacaatcacccacactgtttaaaatgttttaccctctacaatatcagaaacttccctactaacttggtttaatgtcccctcctaaatattcaaagtgtcaacaatttttttctcactcctacttcatttacttgtagtttccctttaggtttccatatagaatcgacattcttcccgtagggtttgccagtggatcttgctgccatggggggcacaagcaaagtaaatgcatttcaattcagaagccacttagcatccaggtggcttggatttttttttcttctttttcttaaatatgaagcattaaaagtcaaaggcattgctgcaccttgagttagtacaaaatttattttaaaatgcatacagttcaaattttttaccttgcataggccataagctagtagtatggtgggtcagttctgacactgaaaaatgaatccagttagagaacctcccgaaggctgttgatgtttgctataataaatagcacacactttaagtcaaactttttcattctgtattcaaaggtaatggatttttcgtaaccatagtaaccttggtgtattctggataaatacgtgaggtatatacattctagttttatttttgaatataaactaccacattatgtattactaataatatgaaaaataggatgtaggttagtataatgacagcttaaactagtatgcattttccttctgcaaaaaataaatatttatcaaaagtataggttcaattaatttttctcccagttttgtggtattctggtggtgccatttatctttttttccaagatctccattaatctcttatttctgtcccataacagatttttaagaattttgaggtaaaaacaattgtactttaaagcttatgattaaaaacataatcgaaagattgaaggacctatattgatatcactagcagagctattgtgggccacttaagatgtgtgtatacagtacattcccaaacaagtagacaaaagaaatccttcatgagactgttcaacataccaggattgtttcaaagttcaggctggacagcacctgatcgatgatgactatccagactgtagccacagattattcttattttaaacgagcaccctaccagaaactggccgtttttaagaagtttataagatgtttccaaaaagcctacaaactttttagaaacaaaaatagcaagatggtgctaatcaggacaagtctccaccaaacccggcaaggaggtttatgcgagttgtgcttcctagttagaaaatactacctgaattgcttttggttaagccaacctaagccattgctgtggataatgactagaactccaaaagaggaaaggttaatagggacattatagaaaaataacaactatctcacaccaagccataacacgtgtgttttcaaatgtatcatctgataaatctacatagtcatcttatagttaaataagagtgactgatatctagaaccatagatagtgtcttcccactgctgttccatcaggacctggatttctatcactaagactgaggcagtaagatatagataatagcaatgtaatgagtgtgtgcatgcgtgtgtgtgtgtgtgtgtgtgtgtgtgtgtgtgtgtaattgagagacagaaaaataaagagagggtagaaaggcagatgtgggcagggggaaagagggaggaaaagtggatgaattctggtaaaatcatataggcaataattatttatgtctaaccaactaaaagtgctaaaactttttttttggtcttatttgccaaggtcaaagagaactatgtgtaaatagcaaaatagaaatgctcatcttaaactttccaaacacttaagtcttacgatgggaaatttattgacgaagaagctgtattgcttatggcacaataaaaacacatttaaaggttaggcacttctatccgagcgttataaggaaccttatcagcactctacaaatttgagctaaattatactcattcacaccaatggcttacagaagctcttttcttagcaaaatagaattttactttaacctagatattttctttattttgcatatttaaatatcacattgcagtacattgaaataactcctcttacataaaaatactattacctaaaggaatgctgttaacacgcctgtgttctgttacaagctctaatattaataaagcagagcatgtgaggatttccaggtaagatgacggtctcatccatgagtcaccatgccactctattacaaacgaggtcataccatgtttccctttgatgtctcagtcatatagtattaaattgtacaaagtctgagaaactttaaggacacgaaggaacaaaagtcaagctatgcaataagtagagccttcaaagccaaattactaagctactaactctgtgaccagagactccagaatagttgttcaaggttgttctatataccagatctttgggttaatgaacagtggatgctatactctcaagagtcttattcatcgagcaacaaagggtcaaatgaaatgaaataacttgtacagaatgtttgaatatcagttgtggttagctgtaaacaatacaacctaagtgtcgttcttccattaaggtgcttctataatgcacccgtatgtgaagaaataaaatatgtttaaatttacattttaagacccgtacccaaatattatatgatctgttaacctaattaaggaatattatgttcgtaaatgatagggaaagattctatgcttaaagggattttagaagaatcatgggaataatattcagttagaaaagcaatggagttaaatgctggaaagataacggaatatgtccttcagttgaaagtgttacaaatagaggtgtcctgttattttcagcattttgagagttgctatgattttttatgtacgttttaaagtgcttaaattgagttataaattaatacagaaaagtggacacatcttaagggtacagcttgatggatatttacaaaggaaacacatctatggaatctgtacccaaaacaagaaacagaacattgtcagcaccctgtaaagctcctcattttgtggcctcaaatcttgactcaggtgattgctttcctgagtgttgacaccataaactgattttgctaattttgtactcaatataaatagaataagaaagtggagggggggtcttcaaaaagcttatggaaaatgcatattatgaaaaatgtgaggatttcaattttttccaccaaaataaactcatactaacttgttataacattcctgaaccagatctagtttgaggtggtaagaaagttaagacatcagtctgaaacaagcccctaccagggcaacatgaattcagtaaaattgaagcaaggacaaatatcaaatttctggtgaagcttgcatagaagaatagtgaaatcattgatgttttacaaaaagtttttgaggacaatgccccaaagagatcggcagtttacaagtggataactcattttccttaaaggacaaggaacaagacagtattaaagatgaagcctgcagtggcagaccatccacatcaatttagaagggaaaatattcattttgtctgtttcctaattgaggaagacaaacaattaacaaccaacatcatacacatctcaattggttcactttgtacaattctgactgaaaaattaaagttgaggacattaaacttagcaagctaacataggaacggaaaaccaaataccacatgttctcacttataagtgagagctaaatgatgagactcatggacacatagaggggaactacacatactggggcttttcagaggtggagggtagcaggagggagaggattaggaaaaaaaaaaaactaatgggtactagacttaatacctgggtgatgaaataatctgtacaccaaacccccatgacacaaggttacctatgtaacaagcctgcccttgtacccctaaacttaaaataaaagttaaaaaaaagttgagtgaactttctacttagtgggtgccaaaactgttgcacccagatcagctacagacaagagcagagctttcaatggaaattttaaacaggtggaatcaatatcctgaaacattttatcaaataattgtaataggagttgaaatatggctttaccagtacaatcctgaaaacaaagaacaatcaaagcaatggctactaagaggtggaagtggttcactcaaagcaaaagtggaccagtcaagagcaaaggtcatggcaaaagttttttggggatgcttgaggcattttgcttgttggttttctggaggaccaaaaaacaataacatctgctaatgatgacagtgttttgagaatgttagccaaagctttagcattaaaatgcccaggacagcttcactagagtccttcttcaccatgatgatgcccctgctcattcctctcattgaacatgagaaattgtatgacagttttcacggaaaatcattaggatcttacagttctgatttggttccttctgacttcttttcgtttcctaatcttaaaaaaatctttaaggagcacccatttttcttcagttaataatgtaaaaaagactgcattgacatggttaaattcccagaacagtcagttattcagagatggactaagtggctggtatcatcacttacaaaaatgtcttgaccttgattgagcttatgttgagaaacaaaggttatatttttattttttaattccattttccatgaaatttttgtagttcccttatatgttctcttttgtcactgtctttttcttagagatataggagggagagtaaatcagtacaacaattttttgtgttcctgtacctacattcagaaccctctgatctacaggcaattgctaagatgttgttagttgttaaattcctgtcttccagaaagccattggaaaatttgcaaactgaaacatctacctctttctccaagttcagatctagaaaataattatagaaatgcttcatctgtgcaattagaatttagcacatgaagtcactgacccgtgtacactagcaacaaacaaaccatataaaccattctgagtttccaacaatgtaatgttgtgtgaccataaagtttatgatgctgtagaaaaatatttaatttggaaagataataacaacaaatattttacacatatttgagtctaattcgttaaaatatatgtgtatatacatagatacatatacatggatgtgtacatatacatatataggtatgtccccatatggacatataccaaaatactaatagtgattatctcttaataatgggagtctggtattgcttttttttcttttccttgagagtcgttcaatcttttaaattctctacagtttggatattagaagtcagattctttttgtaatgttattcccaattttaatatatgtgataaaattgatagaaaggaaagaaatttcgggaacctgactacacttaaccattaatacttatctctagttttccctagtcttcaccttatatttaatcaggttgatcgtcttactaatttccttctagccaataccatagatgacctctagcactatctaccaccatcaaaacgttatgtatatttgatgatctacctcaattcccacatcttcatttgactcatagactcttccatatcaaattcctacacatttgtcatttggacacattctatcttgcaatattgacttattttcaaaggagtaaatcttgattaaaaataagaatgtaagtgcattggttacagttattatgccattatttattttcaaaatttctgtaatatctcacataggaataaggacccaactggcatccaacaaactcactgaattgagtttaaatgaattaagttgaaaaaacactgagactcagtaaattaatattttagagaaaataacaataaataccaatgcataatttggatataattaacatgctaaacttggtaaacaattttattgaggtaggctttcctgtagcttaggatttttcatttaatcatccaatatatagcaaatatatacaaatatttgttgctcaattatgtgttttagcttgctaagactattgtaacaaagtaacacaaactagatggcttaaacaacagaaattgactgtctcacacttctagagacagggagtcccagatcaagatattggcaagactggtttcttctgaaggctatgaggaggaatctgtttcatccctctctccttgttttggttgtttgctggcgatatttggcatttcttgattgtatatgaatcatcccaatctctgccatcatcttcacataatgttttccctgtgtgcttatctgtgtacaaatttctcctttttataaggacactagtcatattggatttgggcccaccttgttgagctcatctgagctaattacaactgcagttctagaggctaggacttcaacatatgaattttggggagaacacaattcaacgtgtaactctagtgctgtgcatttgatgctgtgattaataacattctaaaactttcctgaaatacctaaaacatattagagaatttaaggtgtgtgttcacaatcagttttaagatggatatggcccatgacagtaatgaaaatatttagaaaaggtgataatcaattccatctggaatgctcccagccttactttttgcatcttcacaatcacatctcttacttccctggcttgctttctttgattctttataggagtgattagtttcctagtgctgcttaatacaatacccaaaatgggatgccttaacacaatagaaatgtattctcttgaagtttgagaggctagaagtttgaaatgaaggtatcagtaggcccattgtctctctgaaaactgtaggggagaatccttccttgcctatcccgccctccagtggtttctggcagtcagtggtattctgacagtcagtggtttctggcaggtgtctgtcagtcagtggtatcctggcagtcagtggcttgcagttgcgtcaccccaatctctgcttgtatcattacatagtgttttcccttcttctaaagttctctcctcctctaaggataacagtcatattcaatttagggctccccgtctttcagtatgacctcaacttaacttcatgacatctgcaaataccttattttcaaatgaggtgacattcacatgtacagggagttaaaacatggagataccttttgggaggacaaaattcaatccactacacctccattgactccacaactactttgccactcagttgaaactgttctcacctagattgtcaatgttctggtagtctccaattcagggacagagtggaggttgtataattcatgatgttttattgatgattcctccatctcagaacattcttctcttggtgtctgtgatacctcaccttctcaattttccctattactgttcaagctctggtgtgatctcttcctcattttcttccacgcacaaatgttggtttcccccaggattcctcttgaaacattccacacaatctccctttgaaaactcagtagtccttgtcttcagatatttttcctaagccatgaacatttttctcactgcatattgggcactcctgctacaagtgtttttactccaactccttaaaactgaatttattttatctgccacatcctaccaatgtgctcttttttctgagttttttatctttgggaaaagtaacactattcattctttttcccaaacaaaaacccagcattaatctttgattactcctccttcatccttcacatccaaacttttttgctgttcttgttttaagacagggtcttcctgtgtcacccaggctggatggagtgcagtggcgcattcacagctcactgcagcctcgacctcttgggctcaaatgatcctcttgcctcccgagtagctggggccacaggtgcatgccactacacctggctaatttttgtagagatgaggtttcaccatgttgcccaggctggtcttgaactcctgagctcaagagatctgcacatccagtcttaaaatccaaactgctgttgccctattacacttatcacctggctcctatctactttcttagccttatatcattcttttattctcatttatttctacaacactacattggttttctatttctgttggtttgttttgtgaaataccacatgccttttcctacatgcagacttttgaactttctgttcactctgactggaatttactttccccagttctttacatggctgaatcattgtcttccttgagttctcagatcttataaaaccttctctatatttgttagaataacctagatgttataagcatacacacatatacatacagagagatgatagtttttaatagtgaaaacacaataaaagtttatttcttgttcacttagcattgagtgcatacaaagtttggtccacagagtttcctttttctgcacagtcattcaggaatgcaggcagatgcagattcagattctgtcttatttaacacatgacttccaagggagctctggagttatttccattgctacagcagatgaggaagaagattgagagatcatcatggcagattgttatgggccaggcctgggagtgaaggtattaaagcaataccttgtactaactcaaagttctgtaaatcagaaatttgggtggatttaattgggttcgtaattagggctttacaaggccaaaatcaagagttggggcagtttgggctctcatctgaaggctctgggaaataattcacttctagactcattcaggttgctggctgaattcagtttcttgcagtggtaaggccaaggtccctgtttccatgttgcctgtcagtcatgagctgctatcagcttctaggggccacctcaggtcctttcacatggctccctccatctcaatgatggaggatatccagtccccctcatgcttcaaatctctctgacttttgcctccagctggagaaaacactctgctttaaattgctcgtagttagtttgcacccaccaggattcatttccttttctccatataaggtaagataatcataagtgtgatatctcatgaaattcacagattccacccacactcaaagggggaaaattgtatataggtgtgtgtcactgggagtcattcttagaattcttcctaccacaggttcagaagcagaatcactcaagcatggttcttaccctgtgaccttactaagccttggtttcctggtagaatggtaacaacagtacctactttagggatttagtataaaaattaaatgtgatagtgcatataaaaagattagcataggtcccataactcttctaaaaatggtaaataatcaacaacccatgctattagtcgcagaaataaggaaattattgttatatcatcataaatattcttaatgcaaaacatcctctgcatgcaaaaaaaaagcatgtctctaaacttcatgttcaatttaactcagaaaatatttgttgagcaggtactatgtacctcagaggttagaagttatttataaaactaagatactgtcattcttcctcaaatcattcccagttcaattgcttagacagaaatacataaaactaaatagaatgctgtccaacctgtggtaaattctgtaacatgtgtgacaacaaaagagaagggttcaacccagtgtggaagataaagtgtcacagaagaatgttcacaggctttagagtcgagtttaagaactgaggaacaggcaaacataaggaccatggttgcgtagtcactagacacagaactattaatgcgcatttcacaaaaattaaagagggaagagtttaatatgagtgtgcaccctgggtaagtaatcaatagtgagaagcaaggtgggattgagattatcaaaggtgctaagttatgttgagatatttgaactttgttctgaagcaagagagaaccattgaaggattttcagaaataccacaagacaatcagtgctttagaaaacacatagttggaacatatcattgcttcaacatagcgaagactgagtctgtgtagctgttttctccatttagcaggcataaggacaagtgggttagaacactaaatgcaagaagctaattggacttaacaatacagatggcaaaaggatgaggagaggagagaaacgcattatgtttatttgttaacagctctattgtattgtatttatatgcattagtcagtgtaaaataaaatctgcttattttaaatccttttaaatagtgtttaaatatttcctgatgacacaatctgctaaagtatttacccttggtgcagatttccattaaccttgctgtagatactaagcctacaaccatatatttatagggggctcaattatggggtaaagcctagtgacatcattataaaagcacatctggataagctttagggtctttgtctttctatctgatttaggaaatttagtaaactgtaggagaataccattattaacagcccctgaattctcagattatgaggatgtcctttctctcaaaataaaggaagagagggattaaaatctctaaagctgtaaatgatatagagaaatgcccagtacacagatatcagggatattaggggaatccagttgtgttggatatacaagaagaaaaaaaaggcagaaattaaattcaaagtattctttcctcatgtcttttgtcagtttttttttattgttttttagagagtctatataaatcctttggttccctaaaggacaaaattcctttgataattttacaaattcttttctaaatagtatctctgtattgtagattaaaaaaattaatacctaggaaaggtcaggtcacttctttcagtcaaggaatgactcattcatgaaactggaaagaaaacttctttttcactcaccccaatacttgatagctatcttaaattgaatatgtctttaacagtatatttgatattatcagtgtattttgatttatatatatatatcgtatatattatatatctgtgatatatatctatatatcatttatatatctgtgatatatatctatatatcatttatatatctgtgatatatatctatatatcatttatatatctgtgatatatatctatatatcatttatatatctgtgatatatatctatatatcatatatattatatgtctgtgatatatatctatatatcatatatattatatgtctgtgatatatatctatatatcatatatatatctgtgatgtatatctatatatcatatatattatatatctgtgatgtatatctatatatcatatatattatatatctgtgatatatatctatatatcttatatattatatatctgtgatacatatctatatatcatatatattatatatctgtgatgtatatctatatatcatatataatatatgtgtgatgtagatctatatatcatatatattatatatctgttatgtatatctatatatcatatatattatatatctgttatgtatatcatatataccatatattatatatctgtgatgtatatcatatatatcatatattatatatctgtgatatatcatatataccatatattatatatctgtgatatatatcatatatatcatatattatatatctatgatatatctatatctctctctatctatctatcacattttctttaaccattctatcagtgatgggcatttaggttgattccatgtctttgctatcatgaatagtgctgtgatgaacatttcttttgatttttattgtctgtgttaggacatcataacagggccctcctaataccattaacaacgcatcatgaccctggtaatggttttgtagctgaagtctagatagtttaagtgccctatcttattcatttgtacatattcaatatatataataactactattttctggacgttaagagaattgctgaaaatacagtggtaaactgcaatgaccctatatatcctggtttgtacactgttttatcttctgtttcagttaccttgcttaaatcttgtggctatatgacactaataaaagttaccaaatttgtaataaatagcatcacaaatatttcattgtgcttgagattgtttcaaaggttttgatttttctggctatacacacacatatgtaacataacataattaaaaatgtaatgaacatcactagactactagttaaacaagttatggctaataactaatatgtacacaaaatatgtggacacaatagaacaagcaaatctttatcaataggagaatatcttcaaagtgtatattgtaaagcacttgtgcagaaaagtatattctatattctgctaatgtttatttgtttggttatatgtatgtagactacatctggaggcatacatataaattcaataattgctaaattcctaggagaaaactgggtaatagtgacacaaaggtggagagagtcttaatttttatgtaaggtcttctgtacattttggctatcgtaccatgaatatatattaatgcattattcattcaaaattaagtacaatttaaaaataaaattactacaaaatggtaaattttaaatgttaaagaaaacttggaaaaatataaagaaaaattcaaattgtccacaattttatctaccagacacaatcactaattatattttggcttatgcatttaaagtctgtttttttattattaaagcacagatacaaacatataattgggaccagactgttttacaactttttaccactttataatatactaagcttattaccaaattgcttgctcagcattcttttatgtaacattttgtgtatgtgcattttaagttttttaaaattaataccacaaatgtgtttatgcattatttaaaatgatatattcttcttcctattttgtaaatgttttaatatatatgaaggatgctaaccatttgcatgcactctatatgacagttatttttttccgctttgtcttttgtatttttttactttgtttatggtggtttttaaattaagacatttttaaaacttgtagtcaattcaaatttagatatattttccagcatagtgtcttccttaaatagaaacacttagattttcttcacttcaagaatagataaatatttcctgagattttctttgataatttatactttcaaaaatattttcacatattccagcttctgtgaatatttttatttatttatttatttatttattcatttatttattgagacagggtctcactctgtcgcccaggctggtgtgtagtagaatgattttggctcactgcaaccccgcctcctgggttcaagccattctcctgccttagtctcctgagtagctgcgattacaggcatgcaccaccacacccagctaatttttgtacttttagtagagacagggtttcaccgtgttagcccggctggtctcgaactcctgacctcaagtattccgcccaccttggcttcccaaagtgctgagattacaggcatgagccactgcacccggccacttctgtgaatctttaaattacccaatgatgtgtataagggttcaaattttattcccattttctcagtgaagaaatagagattctgaaaactgatttgatatgcctgaaatcataaagttagttaatgtcatcgctaggactagaattttggtgcttacacaatgtgctgactcccaaatcgtaaatttctaccagatgtttaaagtaaaagaatgatgggaaatttcattaaactattaactatattcagtggtttcaaaatattaatacaacattgatatctttagtgcattatcaatgtattcttggagacaacatgtcaattaaattgtctcttattcaaatgttaacttcagtttttaaaatttaaagctagtctgctgattttcaataagagctgtctaatattgtgaactagtgaatttgaggagataaaagtggaaattataggtctgcagagtgtagcattgataaagagggggccatttcttccaagtcagtaaagaaaagtgatgaaacataaactggaatttttgtgattctactgttgcatgaccttataacacccctgttttaattaactacggacctgaaataataacgtatatttctaatccactcacaggaatggtaggtatattagttagctagggctgccatgacaaaatacaggctgagtggcttaaacaacaggaatgtattgtcttacagttctgggtgctagaagtccaaggcaaaggtttccataggttaggtttcctctgaggcctctctccttggcttacaaattgccgccttcttgcaatgttcttacgtggtcttttctttgtacacgcacaccctggtgtctttattcccatccaaattttctcttcttataagggcatctgtccgattgaattaaggctcatcataatggccttattttgacttaattacctctttaaagaccacatccccaaatatggttacattctgaagattagaatgtcaatttatgaattttggacggacaaaattcagcctatagcagagggtctgctttgcaatgattatgcactattactcaccaaggtagtaaaaattaagcaaacatttatatacacaagtttttgaggggataaagcctacagaatataagaacaaaatattttcaagaatgcctgtctgtggttctttcattaattcacttcttcattcatctttattgagtacgataatgaggcagggaaaatataaccatctgactatgaattgacctggtgcttgtagacatatgtggtttaacagttttccactttgtgtacccctctctcataacatgtagcatactctgctagaattattgattgattaacctcattgtctttctcactagatcatgagtactttgagggcaggaactttatctttcatctttcatcctgaagacatggatcagcatatgtgtatagtaggagaacaataaatagttttcagaatgaaggggagaattaattttttcatgaaaactagatgtcattatgtggagaatttatcagaatgccagactggtaaggatgttcagagacacagtagttgacctaagactaacctaaatctgtttgtatcacagaagtgtaccaatgcttgacatacattggataaaatgtttatttcctatttctctgtattgtttggccacatgactattgcaaagctcataagcacaaaatttgcacaaaacccctgagagatgccatccatggctacaaatacatgttttgattatattaaagtaaaaaaattgatcaattattttaaatattcaaggtagttaagtgaataaattctatgtaattacaaccacaaggttggtgcatattttagaaataaatgcttgttttactatgagaggaaaactgcgaatggcacacgacctaaacaagggcatcctgtttgcttggatgaaaattccatccccatgtttactataccttccactctcattcaaacctagaacaggagaaaaatagttcgagtttaaaaacaaatccagtagagtttaggaaagtttgtctcgtataccacacctttaaaaggctattttgcaatgacaatattcttgtattgccctctctatttttccctccctattgtatacatgagcccagcaacttctagaatatactagcacatatgaaatttttgaatatctatttcatgtagggagattagaaagtcactttctgccacttgtgtagctctattatgcaaaaatcaagaggatgcagatcataaatcccattagggtggaactctggatgtggaaaagactatatagataattttaagagatttcccctcagctgaatcattgctataaagttaagcatggtttttaaaatataaatcaaataaatggtttctataaaggcacatacctttactgtaaactgaactccaacaaacttttgagtggacatttctcaaatacagcatctattgaaaacttcctctgaaaaaacatttcataaaaattgaagcttgccttacatattttcatactatgtggttttaatgaccgttgtattccactctatcaccataaataaatatgtgactttaaaagatatgttgtaaataaaattagctcgaaaatactaacactaaccaaacattaatcacagaatttaaggagactatcagagactaattcagaaaataaaaatattgtaaaattactaccatgaaagctctaagaaaagttcatgataatttcagtgatgctaaggctacagaccaaatataaacttagaaacaaaagtatttagtctaagacaaattaaatgtgtatatattaatttattttctctgtttgatgggcatagaagcccatcaatactctgaatttatattttattaatactctcacaatttactttcatatgtgacttactatgtaatataaaaaacaaaagagcttgaaaaactgagatcagagggcaacaataaaatattaatgctaatattatcttgaatttttatctatacatatttaaatgttgttatcctcactgaaatttgttactaatcagtgaaactttagtatttacctaaattagttcttcttataagtagctcaatctccataataggagatagactataatttgtactttagcataaatattcttctaaaatcattcaccgttttatattgtaattgactgaaacaatataaagtggcttaaaatcattggtatattataaaacctatgtcagataaaacatggcatctgtgaagtttgggaattataacccagaacagtgtataattcaaaacagatacctgaaattatcttgtacacatctcgctatctgctatatctcatcacataaaatgcatagtagatgcacaaagtagctgtccaacaaatacttatggaattaataaatgaaggaatgacaaaaatgcttttcctcaatgtgctaagtcaaatacatgtttccttttataaaaatttaactatatgttttagatttagttgaaaaaatctatactggaatttacataattacataatacatattttaaagtattattcccagtatttatgaacattcattaatgagaatggcttctacattaaaagatcagttagcctctgctatttttgataatgatttaaacttgttaattcttacctgtataatgcattctcctttacaaaatgctggtatggccacttgttttatgttatcctcacaacaattgtaggtatagatgtgataaataatatactcttcctattctgtttttctttttaacaaatgagaaaactgaggcctaaagctccagtgattcactcatgtttacacaaataactctaaactggcgctcagctcttgctaattctttgtctcctcttttgttttgtttttgtttcattttgtttccctaaaccataatgccatccaatattatttaaagtttgcctgcctgcttttgcaatggttcttagctttccacaatagcaagtgcatcaaagaagaaaaaggaaatgattatatggttattaatcaaactcagatatggctagtaccacctttataagtgaaacttatataacaatctcagtttatgtcagtctcttatcccagtgtttaaagttttaaggactgagctgggaatgtgaggaggcttttgcttttcattttgtactctactagttttaatttttcactatgtgcatacatctgcaccccaacctttaaagaattagtttcctgaaaaaaaaggaaaatgcaattcatcgtacaaataaaagcataatcccttttattaatttttagctaacaaacacataataccatcctattccaggtactgtttttaaatgacttgtatctaaatgtaatgttaacgcatactttcgatgtgcataaatatagccaagcagtcctaaattcagataaattatcttccatctactgtatataattatatagtatttcctaatttttataaaatatggtttgtgtgtatgtatactgttactcaaatgaggttttgttgtttttctctcctcaaggtcaaaaacaatatctcactctatcttttgtgtcttttgttttttgatttttttttttttttttttttttgtctgctttgaacagtttttaagaggaaaagaagaaaaggtgtttgggggttacataaaaaaagggagaaagagacccaaatctcctgtctcttttatcacctacaaactgtattgattttcactttcctttcctaaatccatgctttaaagacattgtccatctaagaaacatagagtcccaaagcacaagttttgatgtagtgagcacccattgattgtaccttgaagtggatgtaggtaaacagatgacagatagatcaggtagatatatagatatagatatagatagatttatcttgaattttcctagatcccattaatctgaatgtacaaataagtctcattagttctaatatttgtatttcactgcctcattgccctcacctgctgtagatgatctctgcctccagcaaactaatcctcatgcatttctggggagtccatatgggttttctcacttgcacttaggatcaagctggacaccaattggctaagtgccacggttactccactgggcatctccatgtcccttctctggataaacaccatcatctatgggcataaggagcactgctattcttccattgctgctccaccaggtacctgagctctcccactgctgtgccaggtggaatagttttccaccaggggccaccttagatattcctcgtcaggtgagtaccaggactgctttgctaggtagagctgtcccagtcgattctaatatgcccctctgctgttatatctgtatcactgttctgtattctgctagtaccaaagctgaatgagactatgttaaaagtagtggtggaaaaatgtctttcttccttgcctccctctttcttaagtgagtcctaaaagaatactgagtagattttggtatcttaaaggtttaacaaaacagatcttctttgttttactctaaatacaaatctgagtaaactagccaaggctctcagaatgatctctctcttctgagaaccagggcaccatacctggctccgatttctctcatggtgaattcttcaaaatgttttccagtgcatgggctttcgctgggttatctcccacgttgttcacaatgttcagagatatctgagttaacagcacacccagaggtgttccctctttccatgactgtcccccacaaccccacgccaagaatgccactccccagttctaatggcagtatgctgctggtagcctggccacctgtctcagtccatttagtgttcctataaaggaatcacccaagactgggtaatttataaagaaaagaggtttaattggctcacggttctggaggctgtacaggaagcatggcagcatctgattctgaggaggcctcagggagcttttactcatggtggaaggtgaaggggagcagatatatcatgatgagagaagaagcaagagagagagagagaggaggaagtgtcaggctctttttcaacagccagttcttgtgggagctaagagtgagaactcattcactcccatgagaatgatgccaagccactcatgagggatctgaccccaagatccaaacacctcctaaaaggctcagcctcaatgttggggatcaaattgcaacatgagatttggcagggccaaacaaaccctatccaaaccatagcaccacccaatttgccagatatacccaggcagatctaaatatatcttacactcacaatcaggtcctccttttatgagataccaaagatgttccattagggttctcagacaaacagaatggagaaagagagatttattgtaaggaattggctcacatgactgtgggagctgacaaatctaaaatctgaagtctgcagggcatgttagcaggctagatatccagggaagagttagtgttgtagtcttgggaccaaaatcttcagggcacgtattagtctgttctcacgctgctaatagagacatactcaagactgggtaatttataaaaaaggaggtttaattgactcactgttccacatggctgtggaggcctcataatcatggcagaagagcaagagatgtcttacatggcagcagacaatagagaatgagaaccaagcgaaaggggaaacctcttataaaatggtcagatcttatgagacttattcactaccacgagaacagtatgggggaaactgcctccatgattcaatcatctcccaccgggtccctcccacaacacgtgggaattatgggagctacaattcaagatgagatctgggcagggacacagccaaaccacatcagggcagatgagaggtttttgttcctcatgacacaaaatgtggtgtcttttccaacaccacttcttcaattctctgacactcactaggcatgctatagttcagctcagttctgacagtaactacctggagttagagtaagactccatagatttaagagcccagtcccacaagactaccttcccttcagaggccaggcacaagtattgagtccccactttagccacaattctctccagctgagctacacagtcttgggttcccacaaccccctcttcagggttgataatttgctagaatgactcacagaactcaagaaaatgctctacttactattgcagtttattttaaaggatgcatataaacagccagatgacaaacctcctcaaattctgtttaggggcttttaggaggtttcatgacataggcatgattgatcaaatcattagccattgatgattgactcaatttccagccactccccttctcccaagcggttgctgattgagtagtgaagctgaaagttccaagcttctaatcaaggtttggtctttctggggaacagcccttattttgaagtagtctaggggccgtctgacagtcacttaattagaacaaaagatgctactatcatctttatcactcagaaaattccaaggattttaagagttctgtgccagaaacctggtacaaagaccaaatatcttcttatatcactgcaggccagcagactggaaactcccatagaatttttatcatgcagtcttgaggcagaattctttcatctttgggaaatttcaatctttgctctaaaggctttcaactgatcggatgtggccaacccatactatgtagggtaatttacttaaagtcaactatctataaataaatgttaatcacatctaaataataactttatagcaacatttagattggtgtttgatcaaacaagtggataccatagcctggccaagttgtcacacaaaagtaaccatcacagatgtattattttatttaaaatcatcagtattatatgaattaattcagaaataaaaaaggtgttgtcatagtgtgaacacttataagtgtctttcccacagaaatgtcaacagactgtgatttgaaaattgctgttttaaaagagaaaagctcatcattctacagaaatgattcaaagatagacaatccattaaatatcttataatgggccaaatactactagttgttaatttacacttgcaacatcaaacactttaccagctttttaacatgcaactgttgcatatgatgcattgtgttttttgcaagtaggtatacagcataattctaataggatatttatttacaacctaaccttacaatttaaagtctgctactccattgtgctcatcctacccgctgtcttcttatattcaaagctattaaggagtacttgctcagcatatcactccaaattaaactgcaagacattttatgatgaattaaatgggtgacgctctcccagcctttgtaactactagagcaagtatccaagaagcagacaattttatcacaaaattctgattgccaagttgtttttattaaatagacatacagtagagaatttaatcttagaaagcatctaacataaacacagatttctcgttttatagatgaataaactaagatccaatgagggcaactatttttttccaagttcatgcaggcagctaacaccagaacaaagactaaacaaagctcttctaacttctccccccatttttatcatccattgcattcattactacaaaattactacaaaattattagcctggtctttaatggtggccccaaagaatggtttttagtattacttccttcacttctttcgtatgtcctgtgctccagctaaactgaactatgttgaactaagctaaacatttctccttaagcttgtactgcattttgctacagtctttttgccaactcttcccatccagaatgtcttcactctctatctccactgctttaaaacctaagcaattttcaatttaagttctatctcctttttgaagtattgtatattcttctagccagataaaattctaggaaaatattgtcatacttgactgcataaagatttaaattgtctatatagcaaaataaaaccattattgaaatgataaaacaagtgacaaactagaacaaaatactttatagcatacttatttaataaatatctattgatagcttgctaagtaataggcactatactaggtgctatatccaagtaatgttgacttattagctttcaattagaaaaagagaaacactattagatatgggtcaattagataaacaggcacatccaaaaagaaaaaaatatgtaaatatagtcacagagataataataataataataaatgagatgctacttaacatttttcaaatgtgtaaatattttttaaaattagatttttccatattgattagaagatggagaaaagagctctttcacataatgctgctgtgaatgaaaattggcaatttatatcataatgtgccacagttttgttctgtatggtctcaatcccccctgtaaatgtgtgctctacttttctctaccttgtcctgagctttagcctctggattctctttgggttctgccaacgtaagacacaataaagagaacaacagacaggagggaatgaggccgaagtgtttattcctcaggctctgtgcttgcaagggtccccaggctctgtgcttgcaagggttcagatgggcagtagctgttcctccattgaggggaggcccttcctacagtacagctgtctttccagctggatgtggtcctcagcctaaggcagcaatggcttggtctgtgtttagccactagctgcgttcttattcttgaatgtgccccttaagcctggcccaaatcctgtaaatagtccctgacatatttctcttcaataattccatttcagtgtgccatcttctcccttgtcaggaggaccccaaatgatccctctttgactgggaaattctacttctaagagtttatgcttaaggtgtaattaagaatgtacccaataatacagtaatccatattaaatgttataatagtagtaaaaatgacactagtgaagcacaaaagagaaattaatccaaactgaaagagtttgagaaggtttcttatagggtgtggcatttgatttgtgtcttaagggtagcatgagactatgccaaaaaagaaatgtgtatgtcttgccacccaaaagagatatcttggccattgaggatagagattcattactttcttatgctatataaggcgtagtatagggctaggttgaaatagtattaaaataatatttaaggattgattataggttttcattgagaaccattctcaggtgatactttactaagctgacaatagacttagcactgcctggcaaacagcaagtagcagtcagtgatatagccatgattattactgaattaacagcatcttaatcttcactacgatatttgaaagggaacactgattcataaacctactcttttcctgccacaggtagtcaggaacttattattcttattatgtctcattattaacttctgttgcctaacaagatattatatattgtatgtcacatgaatattttcttacaaagtattaattgattcctaatcttgttaaagaatatgatagtagcaaatatccaactaattctgagagaaaaacctccagttttgcaagaaagatttagccaagttatgcaactaagtttgttcaaataataactctataaagttatctcgattatctcctctttagtttatgaatcgaaagcattgatgaagatcaaaagctaactgatgcctccctaattctatatctatccttgtgcagaggcaaagtaggggagtcagtaggatgtttgtgtgtgtgcgtgtgtgtttttgtatgtgtgtgtagatggagacagagaaccatagcaagatagagagagaacacgagaggagactgagagagaaggaaagagggaggaagggatggatggatgaaacgaggggctttctctcattttatatcataaaagtaaccaagaaaaaaatcctgggttcaatattttataattattacaaatggggtattagagatgttcaggaagccagagtagaaggcagctagctaagaatgctgtcagcctaaggagtttttcatggacgcctttttattctaaccagccacagaagaaaagagggaaatgaagaagcatcatccttcactatcacaactgacaataagggttctcccttacctcccacccccgcccccactacacacacacacacacacaaagtagtgactgaaaaccctcagcaggctgggctcccctaccacatgccacctgctgcaaatgtgttggaggcaccaggtcctcctttcttttttgccagttttcttattgcagaaaggttttactattcaacaattaggagtgtccaaggtgttaggggtcataagatacatccttgttctcaaagcgcttataacactgtaactactgatgactggtataaggatgcttacaagagaaatttattaaaagggcaactcagtagagtacaaactacgcatatgttgaagagagtcaggagatgtttcatggataatgcaaacattgaacagggttttcatgaaagggagggatgtggatttctctgataaggtggaaaacataagcacaaatggaagaatttgttgagtttagtatgtggtttgtgttcagttttaaatataagtccttatcatagcaaagcgatttcttttctttttgtttttgttttttccttttttaaattattttactttaagttctagggtacatgtgcaaaacgtgcaggtttgttacatatgtatacatgtgccatgttggtgtgatgcacttgttaactcgtcatttacattaggtatatctcctaatgctatccctcccctccccgcccaccccccagcaggccctggtgtgtgatgttccccaccctgtgtccatgtgctctcattgttcagttcccacctatgagtgagaacatgcggtgtttggttttctgtccttgcaatagtttgcccagaatgatggtttccagcttcatccatgtccctgcaaaggacatgaactcatccttttttatggctacatagtattccatggtgtatatgtaccaaattttcttaatccagtctttcattgatggacgtttgggttggttccaagtctttgctattgtgaatagtgcggcaataaacatacgtatgcatgtgtctttatagcagcatgatttataatcctttgggtatatgcccagtaatgggatagctaggtcaagtggtatttctagttctagatccagacacatgaaaaaatgctcatcatcactggccatcagagaaatgcaaatcaaaaccacaatgagataccatctcacaccagttagcatggcgatcattaaaaagtcagaaaacagaaggtgctggagaggatgtggagaaataggaatgcttttacactgttggtgggactgtaaactagttcaaccattgtggaagacagtgtggcgattcctcaaagtgatttcaactctacagatcagtttgaaagcacaggactggatctcagtgatggttaattgctcatctggccaaagaaaagcatgttgcaaggttaaggctcctatgaggaaaaggagagcaaggatgttcaggctgaataaagcccctgtttttattaattataaggtcagaatctggttctcctggaatcaaaatgctgagcaagcaattgtggagcaagggctacacaatggcagagatgaatgcaacctgatattccacatgcattctggcgcagctcattgcttttcaggcatctacgagaaacatatcaccccttaggtttgctgccgaagatgtgttctcactgaaccataacctagcagaggttctcaggttggaataccaaatagcaagatgatgtggtcagtgctacctatattgctctaaaatttttaaacatctaattgatgatttgtgggaaggttgcacagagagaagaaaggaaaaccaggaaaaagctgtgtttttaatttatgaaatattaagaagttttcggaagaagacccagacaatatgtattagatcataaagaagcaaaaaagtgctatgtaattttctgatggtagaaacaaataagaagatataaattcctcagtttacaccatgagtttaaagaaaatcatcacctacttactggttcattttgtaaattgagatcaatgaaattctctgaacaacagcatgaaatcaatcgtaaaatagcacataattcatggccagtattgtaaattatagtttgcttgacagtaatcggtaaggtttccatgcactgggatgcatttccttgtaacacgtctaaggataatgcctgtggatccatttctaatgcatattagagtgatctgtttttccctgtccacaactccctgtgtttgatcttatgcaaatgatgcaatcaagcaaatggaaaacaagatgttgttgctcaggggctcttacaaacagtggccttatgttttcagggtttccccaccctccatttacccaactcagatttgtgtacatacctgcaattgtttgaatccgttgatccatttgtgttgcccttgaagtgcctaatcacatctatagagacatattaccaaatcagttgcagttaagctaggaggagagttgtcattactttcctctttgctttaaatttcaaattggtggctttgtttatggcttcactctcaaagaatttatcagcctcacttccctgtaaccaatctttttttcatttctttttgttaactgtttttaaaaactctctcattccattcatacattttacacatgactactccttccccccacgcccaacctgatgcctcctcctcttctccatttttttccctttccctcatcatttcctcctgttttaccaagaatttcccaatcagatcaccgtgcaactttctctgccacatgtcaaattaggttctcttctctctctctctctcttttttcatgctttattattcaaagaacactagtaacatttcatcttcttatggaaatacattgagaataatccactttgggatggacagtacaggcataaaaacaacttggaactcaaaaaagctatttaatcacaatggttttctttgtattatgtttacagttttcagatttttaaaaccaaaagaaaatacccaatttctattgtagtgactttcatgtgagtccgtgtgaagagaccaccaaacaggctttgtgtgagcaataaagctatttatttcacctgggtgcaggtgggctgagtccgaaaagagagtcagcgaagggagataggggtggggctgttttataggatttgggtaggtaaaggaaaattacagtcaaaggggggttgttctctggaggccagagtgggggtcacaaggtactcagtgggggagcttttgagccaggatgagccaggagaaggaatttcacaagacaatgtcatcagttaaggcaggaacaggccattttcacttctttcgtggtggaatgtcagcagttaaggcaggaaccggccatctggatgtgtacgtgcaggtcacaggggatatgatggcttagcttgggctcagaggcctgacattcctgtcttcttatattaataagaaaaataaaatgaaatagtggtaaagtgttgggacagcgaaaattttgggggatggtatggagagataatgggcgatgtttctcagggctgcttcgagcgggattaggggcggcgtgggaacctagagtgggagagattaagctgaagggaggtcttgtggtaaggggtgatattgtggggttgttagaagaaacatttgtcatttagaattattggtgatggcctggatacagttttgtatgaattaaaaactaaatggaataagagaaggagaaaaacaggtataaaaggtctaagtattgggacgactcaggacatctgattagagagtgcctaaggagattcagcatagtcctgccagcaaagattatttatttacttcaagagttaagagtggcagtttggggatagcatgaggagatgtcagctgtgatggcttggagaaacagtgtaaactggcagtgtaaacaagagcaggacatgtatgagtagttgagaacggtgaataggagtatgactagacagaagatagtagggatgacaagtttttttggggcacagtctaagttggtctggtgtctggaatgagactggggcctaataaaaaggagcgtctatacaggagctcaaatgggctgtactttgtagcattccgaggacaggcctgacttctgagaagggaaagtggtaaaagtattgtccagtcctttttaagttggcggctgagcttggtgaggtgtgtttttaaaagacctttagtccgttctacttttcctgaagacggaggaccgtaagggatataaaggtttcactgaatactaagagcctgaaaaactgcttggctgatttggctaataaaggctggtctgttatcagactgtatagaggtgagaaggctaaactgaggaattatgtctgacagaagggaagaaatgactgcggtggccttctcagaccctgtaggaaaggcctgtacttatccagtgaaagtgtctacctagactaagaggtattttagttatctgactaggggcatgttgagtaaagctaatttgccagtcctgggtgggggcaaatccttgagcttgatgtgtagggaagggcctgaataatccctgaggagtagtagaatagcagatggaacactgagaagttatttccttgaggatagatttccatgatgtaaagaaaatgagaggttctaagaggtgggctagtggcttgtactgtagcatagcctgcctttgctggtgtgtgatgattaggcctggtggaactgccatcaataaatcaagcgtgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaatcaagcgtgatcaggctgaggaacaggaaagaaggaaatatggggaaatggggtgaatgtcaggtggatcagagagatacagtcttgggtgtcaggtgtggtatcaggaataatgtgggaggctggattgaagtccgggccaggaacaatggtaattgtgggacttaacaaagagtgagtacagctgaaggagccgtggagcagaaagtatatgcgtcaggtatgaggaagaaaatagattttggaaattatgagaaatgtagagagtaagttgagcatagtttgtgattttgagggcctctaaagtattagggctgcagcagccgctgcacggagacatgatggctaggctaaaacagtaaggtcaagttgtttggacagaaaggctacagggtgtggtcctggctcttgtgtaagaattctgaccgcactaaccatgcctatgaaggaaaggaattgttgttttgtaagggattgaggtttgggagattaatcagacacgatcagcagggagagcacatgtgtttttatgagaattatgctgagataggtaacagatgaggatgaaatttgggcttgattgaagtaatgggggctatctgtgaagctttgaagtacagcccaggtaatttgctgagcctaatgggtgtcagggtcagtccaagtgaaagcaaagagaggctgggatgacgggtgcaaaggaatagtaaagaaagcatatttgagatccagaacagaataatggattgtggagggaggtattgaggataggagagtatacgggtttggcaccatggggtggataggcaaaacaatttggttgataaggcatagatcctgaactaacttgtaaggcttgtctggttttaggacaggtaaaatgggggaattgtaaggagagtttataggctttaaaaggccatgctgtagcaggcgggtgataacaggctttaatcctttcaaagcatgctgtgaggtgggatattggcattgagaggggtaagggtgattaggttttaatgagatgttaaggggcgcatgatccgtcgccaaggagggagtagaggtatcttatacttgtgggttaaggtcgggggatacaagaggaggacgcaaaggaggctttggattgggaagaggggcagcaatgagatgtagctgtagtccaggaatagtcagggaagcagataatttagttaaagtgtctcagcctaataagggaactgggcaggtggggataactaaaaaggagtgcttaaaagagtattgtctatgttggcaccagagttggagagttttaagaggtttagaagcctggccgtcaatacctgcaacagttatggaggcaagggaaacaggcccttgaaaagaaggtgatgtggagtgagtagcctccgtattgattaagaaggggatggacttaccctccactgtgagagttacctaaagctcggcatccgtgatggtctagggggcttccaaggcgatcgggcagtgtcagtcttcagccactaagccgagaaggggtcagtcagagaaccttgggccagagttccaggggctctgggagtggctgccaggtgagctgaacagtccgatttccagtggggtccggcacagatgggacgtggcttaggaggaatcctgggctgcaggaattccctggcctggtggccagatttctggcacttgtagcaagctcctggaggaggaggttctggaggaaggcctggccgctgcagttcaggcatttggaagttcttgtgtgctggagatgtggctggggttcgtctcacagtggaggcaaggaattgcaacttttttctattattgtacaccttgaaggcgaggttaattaaatcctgttgtggggtttgagggccagaatttaatttttggagttttatttaatgtcgggagcagattgggtaataaaatgtatattgagtataagacagccttttgactttttagggtctagggctgtaaagcttctcagggttgatgccgagcgaccatgaactgggctggatttttatatttgatgaaaaacagcctaaacgctatctgatttgggataaagaaaaaggagcattaaccttgactatgcctttagctctagccacctttttaagagtaaattgctggtcaggttggggagggctagtcatggaacgaaactgtaagccggactgggtgtaaggaggggaggtgataaaaggattatagggtggaggagcggaggctgaggaagaattgggacctagcttggcctggcgaggagcagtctggggaggaggggagaggtcagatgggtctgtagaaaaggaaggttagaaagactcagccacgcttggacgcttggggttgagactgaggggacaggtgggagggaaagaaggaagatttgggacgagttgcactgggcacagagactaggaagggaccgatgtgtaaaagaatgcctagacgtcaggcacctcagaccgtttgcctattttatgacaagaattatttagatcttgcaggatgaaaaaattgaaagtgctgttttctggctatttggaactactgttgagtttgtattgtggtcaagcggtattgcagaagaaaataagacacttagattttaggtcaagtgagagttgaagaggttttaagttcttaaaaacacaggctaagggagaagaaggaatggagggtggaaggttgcccatagtgaaggaagcaagcccagagaaaagagagagtagagacacggagggaaggggttcaggggttcttaccctccagaaaagtgggaaagaggttggggcatggaaataagggattggggcacagagatataagaggtcagggtgtggaaataagggattggggtgcagagataagaggtcggggcacagaaataaggtattggggcacagagatacgaggttgggatatttgcccctcccccagaaaagtgggacttgctgctaagggtgaaggagaagaggttgggggtttcttgccccccagaaaggcagagaaggggtgaataatcagagaggcgtccctgcaatgattaaacaccaagggaaggctccttcccagtccgtgactggcgccagagttttgggtccacggatgaaacatgtctcctttgtctttaccagaaaatgaaaggaattgaaattaagagaagggagagattgaagagtggaaaggagaaagtggttgagggatagtgagaaaggttggagaagagagtaagaagaggttgcttacccaatttaaaattggtgagatgtcccttgggctggtgggtctgaggacctgaggtcgtaggtggatctttttcacagagcaaagaacaggaggacaggggattgatctcccaagggaggtcccccgatccgagtcacggcaccaaatttcatgtgcgtccatgtgaagagaccaccaaacaggctttgtgtgagcaacatggctgtttatttcacctgggtgcaagtgggctgagtccgaaaagagagtcagcgaagggagataggggtggggccgttttataggatttgggtaggtaaaggaaaattacagtcaaaggggggttgttctctggaggccagagtgggggtcacaaggtactcagtgggggagcttttgagccaggatgagccaggagaaggaatttcacaagacaatgtcatcagttaaggcaggaacaggccattttcacttctttcatggtggaatgtcagcagttaaggcaggaaccggccatctggatgtgtacgtgcaggtcacaggggatatgatggcttagcttgggctcagaggcctgacagtgacgacatagcagtcagatttcccaaaccagaaatctgacctaacaaactacttttttggtgtgaattagcttatcttaaaaacttagaaaacatttcaattgtacctaggttctgaaaatcttgtctgtgtggttatgataagcataggtgaggtgctggttgagtatgtggcattcataaatttcagtcttcaagacatatatgtatgtctctatctctgtgtacagttatgattttatttctataattcagtttaatatctgactttactcccatgcaacttagtagtaagtaaatcacagtcactttgggggtccccccacctctactaattatgtaaaagcttctggggtcttacctagttccttagcatctggagtgtggccacccaggatgctttctttctctgtgcaaagggataactattgagacaacccttccacattcagtgggtatcctcagtgcttctacatcacacttgggcaactgaaatctttacaaggttttctgtggccctgcctgaatacagacaccaaagtctttctttttgctctggtcttgcccccgacctgggactctaccttgaaaacaggggtcagggcccctccttcagagagcttgcacatttctacttccttttatccttattccatcaggcagggaattctgaattagggaagtggaagactccatacttcctatttctcccaacattatatctgagggaacagagtcttccttctctgttccctcagtcactctgtccagaagatttttttgtttttttttctgcctcctgaccagtcacattctgttttacagagaaatctattttatagttaaattctgattttataatttaattgagtgtactagttcgttttcatgctgctgataaagacatacccgagactgtgtaatttgtaaagaaaaagaggtttaatggacttacagttgcatgtggctggggaggcctcacaatcatggcagaaggcaaaaggcacatcttacatggtagcacacaagacagaaatgagagccaagggaaaggggaaaccccttatggaaccattagatctcatgagacgtattcactaccatgagaacagaagggggaaactgcccccatgattcaattatctcccaccgggtccctcccacaacatgtgggaattatgggaactacaattcaagatgagatttaggtggggacatagccaaaccatatcactgagaagcatttagataaaaattaaatgcagaaaacatatagggtcggtagcagggaaggacggaagaaataaaataggttagtatgacaatcagattgatctcagtacccattgaacaaatcctgagcattgtaggagtttagaagaggaagctctaagggcttcaatgtaaacccttacttggttcctcaagagaattgtccaaactatgaaaggagaagaaggaaaaacaaatcaatataatgaagagagtcacaaaggaacaacataattatggctgaaaagttccaaaagcccagttcaaactggaaaacctgaaattatactagactctttcagtgtgttcagtgacatctctcggaaacatcttagagatatgagaagtattagagacataagatgataagatttatccagaagtgggaactgggatagccatatagaagaggactggggatgtgaagaaccctatgtgacccagggagtatggctttgtaatggatgatcaaatttcattgatgagggaaatgaaactattgaaaatatctgggaataagaaggtaccaagagactggacattgtgtagcggcataggagtgattgcattgatgtgacaagtggaagaggtgggaagtaaccagtttgtggtcagagagtgcaggatttagatttagaatcttggaaatcattctgaagattatgaagtagtaggtgtaactatgctgaatgttgaataaatgaagtagaggtgaagggcattgcatttgaggaagttaaagtaaagccagattcagagatgagtcattattgaggatgttagagttgccaaaaagggattatgattgaaaagaaaactgagccaatgctgaagtcatagaggagagaagcagtgtgaccggagatgtgatgggggcatgcgttaactaggttggggcatatcttcttttaaataatggattgatattaactatggctattttttctccatctatgatataaatatatatcacaaaaaatttgaaaaatatatgtaacaaaaattaaatcctctatatgcactcactcagaaaaacattgttaacatttggtttaccactatctcctgttttgtttttattttttttattgtttctttcttttacaatgaagcactggtactttaaaattatgttttggcattcagacaggtacagctttgcctttttctcgtatttaatggtaaatctcctttgtcttacaactatagacccctacattggcccaacaattatattcattatattcttggagactttaaaacatgtttagacattactatatttctgagaaaaaaaaatggcagcctgggtagagggcatggggatatccttctggtcttgctcattcatttacaacaagtaaaattatgcgagttagtcatcacaccattcctggagatatcctgctgaacatgataaaaaatatttatctgaactcaagaagtttacattctcctgggaaggatataatatcaagatataaatgaaaaggcaatattgaacttgttttagtaattatgatatggaactaaacaaggtgatataacaagaacctggggatgatggtggccatattgttcaattatcaagaaagaccactcatagaaggatgaagctgaagcataagaaagagcaatccaagtacaaagagagagaaaatagatttcagtcagaaggagcagcacctgcaaaggcccagaagtgtgaacttgttgtgttagaagaacagaataatgtctagtctagtgtatgaaaaaaatagggagaatgttacatcaaataggatctcattgaccattattagatttcgttctaagagcagaagaagggtactacagggtgttactctgaagaatcaaaagatcactcatggtaaatggtcttgttttcttcattgggaaaattgaagtagttagaggataatgcccatagactctgctaccatctacccacctaccagtattggcacccacatagtctgcatcccctcccattactatagattgtctctgttccaagttcaactctttcacttttgaactagattctcctctttcacatattcaaggacaaaactccagcaatttttttctctttcatccacttcatagttttcccttcactagtgggtcatcccatcacatacaacaaatttttctctcatttaaattactttaaaaatcttctcttgattctacttaccttttatctattgctacatttatctgttctcctttaccacaaaactttttgaaaatgttcttttattcactgtttctaattcctcttctatttccttataagcccacttaagtcaggctttagtgctgacaagttcactgaaacttcaattgtgcaattactgatgactgccatattgttatacccgatggccgatttttaattctcatcttatttcacctttaactcttaaaaattacttcctttgactttcaagacaccataatctcaatgttttcctcataccttactggtcactctctgtctccttggttgatttctcctttactcattggcctcatatgttggtatcccagggttttctcttttatatctattctcactccgtttgcactcctagccatctatatgatgatgacttaccaaattatatatctcaagccatgaactcttcctgtaattccaaacttctgttcaaatatcctgacaatctcctcttggttatctaactaacatagcaaatgtctaattgacattcattatatgaattcttatcttcccctccatgccttcctcaaccaataaaatggttactttatccttccctttgctcaggtcaaaagccttggagtcaactctgggtcttctctttcatactctacctacaatgcactgggaaatcctgttagctttgcctttaaaacatattcagaatttaaccatttcttacttgattattactggcccccacttacttgatattacaaatagcctcttcagtgagatgtattcttatgctcttgctcactaccatctatacgtctggcagccaggatgatactcatgaagtccatgtttgattgcatgacagctctgttcaaaatccttagtgtcttcctaagtagaacctcttagattaaaaaccaaaattcttacaaagacctacaaggcctgcatgaactgacccctcattaaatctctaatatcatctctaacttacttcttcctaatttgttctgctccagccacctcagcctccctgctagtcctcaagagtgtcaggcatgtccctccttccacagctttgctctgcttgttccctctcttggaatggtccaacccaaaaattcccataacttttacactcatccccacttcaggtctttgctcaaaatgccaccttcccaatgaggcctctgctgactcttaactattaaaattacccagaacttctaattctccttcctctgttctgtgttttctgcagcagttttcatgtaatgcagcatgaacatcttaaactccgttacacattcactttaaagacatgctatcttctaaaatgcaacacctttcttacccataaacttcataataccttggataatctagaggcaaaccctaactagggatggaggatttgacaagctcaactaaactatttctatttcaatcctggctcactagccattctaaccctctcaagcaacatgagaggtatacttgttctaagtatactcacttcccatcctgaccgccccctgccccagtcccagttgttatagaaacggacacttcccactccatggaagaatccgggcacggataacaaatcctgaactaattgcttcaggaagctccttccatctgaggcggatattctgggtgggtttagggcttaggtgatcatagtcaccttcaacgcatgcagtttataggggaaaggtgagtggggcactctgtgataagcagacactgcgatatgtgataatatgatgatgcattcttgagatacctaagtcctaccttgagatacctaagttccagatatgcaagtctgtaccatggaaacatacgcaagcaagcatcgggcctttttgaatggagtaacttcttcaccacctacaagttgggtagctaaatccccaccccagcaaagtagaatgtaagaaagaaggaaaacctatcccactccaaagagttcactggccaaagaattttgtagcatccaatctcggttgcggctgaccaagacaatctgatatggctattatatatttcaaggtcacgtggatttggccacatggaatataatttctggctggagcatgttctttcagaaagttggatgtgttctcagttgaaacactataggttttctccaattgcactgaattacccatcaggaattcctctaagcttggtgacctccttggttttgctcctgcaacgggacttagagtcaaatccccagcttctctttttcagggaggacaaggaattcagacagatgagaacaatgagagagagaaaggtcaccagagagcgaagatgaagagaacagaggaatggcagatacaatatgttagcatataaacacattataattttggccaagattggccctgtcggtaggagtttttctttgcataaagttttctctcagtaaataatagtctactctctcggtagcatctgaggccactgctgtaatgattttttaacttcataagtttcctagaacgttggtccaaatgaaggcaccccagttatgtctcagtcgtgtacctatagtgcgactgttgctgccatctctcagcagtccctggcaatgccacactgcttcaccatcagcttcaaagtgtccttgaagtatatattctgactacattgaatgggagtgccccatctcaacttgcaaccattggattcctgtaggatagaatttgtaaagaaaacaaggtttaatcaaaagcattaagagtctcttcttgttgacaactttttgttctaaggtaaccatatttactgtaaattatttttttaatctctcttctagtgacctacatgtttaaccaattgattgtactttgcatgaaaatcaaagtgttctttccccagtttacttttgttatcagtgcaatgcaaaatctgtttgcctgaattaggttgcatttcattaatctcttcaatatgaaattgtggtggctcatggttaatgagatttaagaatctgtgttacttaaattgtgactaacttattttaaaagtatgtcagaaaataatgattgtttctagtagtgttaaagtattaatgattagtaagtcttggtacacctgactgaactttggttagattaccaagtgtaatgaagtgttcaggatatttcagaattgagttagtatattacagattagtttaatctaatacaagagaatgtggtatctattagaaagacagacaatataaaataccagggaagttcaggggagggagagattctttcagcctagggcactaccctagtctcatggtcatctttcagacctagctcgtttcattcattaattattcattcattcaaacacacatattcaaaacctacaatgtgccaggtattgtgctacatactaaggatgcaaaatgaatatattaccattcctgctcttaaggtatttagtgtatcatatagtcatgacacagtgtttttaagtgttaagctaaaagtatgtacaaagagaaagagaagaggctaatagctccatcttgtgctggggtgacagcaaggagtgttagggacatcacaaggaagaaacaggcatctgcactgcacctcgacaatttgaaggtcaaataatagtcaggtggtggacaggagaagaatggaatctgacaaacggaattacaagctcaaagtcattgttacaagctatgtattggcatttcaaaggcaactcctgttgtcttcaaatatgctttaaaataatttaaacatctcatttatttttaaacagagccattgaactaagactaaacttagcaaatgatttacctggtcacagacgttcaagaaaacagtaaaactgttaaaatgaaaaagtcaaaacaagagtttgattgacacttgtctatttaaacataaccaaagtatatttaagggatgaagcatcctatatgttattgctattgatttttatggctatttattcatattttaagccttatcttaacaattctctgagataggactatagtggaggagtgaaatctcctcaataagaagtataatgctgagtaaattcttgtttctccctatcccctagatttagcagtatttacaccccaccagtttctactaagtgcatgcacacatgtgggctgtacaaacagttcctgggtcctactgtacacagcacagctgccaccagaacacgtggattccccagttctgactgtcctggattctagaactatacacatacagtaagtagaaatgttgtctctctcacatgctggttcatgcaagaatctcagtgagttcaatcaggggaggagcttgtgacataaaattaattttattgtgattaaatgcatagaagtgattagttcagtggatctgggaacctttgattatcacttgccagcctaatttccattttgtctttatgcaatcaggctgagctacataggtacacagattccatgcaaacttcaataaacaaaaaactgaccactttcatgactgccttgaatattttatgtttggggcattatttgtaataatttggaattagaaagtatgtatatctttttgagtatagtccaggaccttcttattcccttattacctgcagttgatgtcagaaaggaagtttcacatataggcatgttctgatgatttctggtattactgattcttgtccatttcctgatacctgaggtataaggtgtactattgtgctgagctaaaatctaataggtctctcttatcaagagttaatacttgttcatatttatctcttctggactcagttttcttatctgtaaaataagagtttagactaaatgaattctgacatttattcaagccgaaaaatattatgattcagatctcattgttccatgtctaaattctcctgttggcttcattgtgcccctaagccaagccacgttacttagccaaaaagatttcccacgactcaggtgtttctcagcttaacaatttcctgtctgttctatgacttgcccttctcatttccactgctaagttgtaaccctcatctgaaatgccctctgttcttccttctacctatccaaatccaatccatctgttaagaataaaatcttatgtatctaagtagtgtgtcacttcattcaagaagtcctgcctgattttttcagcccttccagtcatcaatttcactgttttctctaattacatattaaccctgtgttggattcctggattttccaggacaattatattattccctcttttccccatatctaagttctcagaagttctgcttctgaagtttttgttctacagcttaaattcaaaataaatactcgcttatacatttttgtattgttagctaattaaaattacaggtaaccagatggcaggagccatatcacatttcctttttgcccctcagaataggcattggataactacttcagtgttttattttaaatgaatcaattttgagatttatgttttttaaaaaagtgtcacaaatccaagttcaaatgtgtcctttgaaaatcctgtatattttagttttgacttgaatgaatgataataatgtattttaccattcccaggtggaaacaaccaagaaaaataagtgggattctggaacgctatgtattatatatgtcaaaccatacacatgattttacaatttggagtgtcatctataacagtacagaacttttccaggatcatatgctacaatacgttttacctggtaataaatatctcatcaagctgggagtaagtttatttccatcactttctctgtccccattccttccacttcttctccccttcccgtggtccatcttttctttctctctcacttaaaaaaaaaaaagtcaaaatcttcatgtattgctgtttatactgaaaactctcttcccatcctaaatgtgaattctggtgatctaatacctacacatttattttatattatgcaaatgatagaataacaccctgagtcagtagattttcccaagtcaaagttgggattatcaagattttcaaaattacttgtagaacatcataattgttaagaactttttctaaagtgctaggattcataaggttatttccctgtggcatttgtattcatttaaaaaacaatgcacagtatgaaaatttagatcttatatttttaaatggaagtttaaatgaccgtcaaatattcttgattgttattacattctggtttatattatgctcctatctcagaagaacagtcacttaataaaaccccagaatcaacatagtttagaggttcccttagacaaacaatagcattttttaaatgcaaaaatagcacttttacacaaaggtcttttaaaagaccttgatattactgtggaatttatactcagtaattccttttgttttttgatgaaatataatcttttttaagtttaatagcacgtctgaaaataactgaatataaacatgagattgtccctatttgttttaaacacactcttcattttatagcaatacctatataaggatatttgctttgataaatgccatagaaaatattctgctcttgattatgaataaatttacatttatgtagacactgtgtatgcattcattttacttaacatgctcttgaatgctctaaatattataccatgagaaaataaactacactcaactattgctaactgtctgacttaacaccacaaaacaagggcaatcagacagtggttaaaaaaatactgttcaaaactgactccatgtgcctaggtgttctgcacagcagtttatgaaacagcactttggttatgtacagttttattacccattaagtaagaaatatactaacttgattttcaaatgctaacacagaaatacaaactattttcaaaataatggtagtatcaaaattaggaagagtcttaattttttggaagcaaccaaaactaaaccaaaaattgtgctcttggttgtttatcagaagtaggcaaatgacatagaacagattctcttcctagggccgtttttaggatgtgctgtgcagtcaatcaattcatatcaatctcctagattttataaatctataataccttgaaaaatacatactagtagattaggagtcctctgccctgagtattaattcagattttactacaaactgtgtgacctaaggcaaattcacttaacctcactgagttttattttcttcaagtctaaaattagaacattgaactaaatgatgtttaatgtctctgagccataaaattctatgatgctaaaaaaagtaatcccaaacactattctatggagtcaaatgctatctgtcagccgctgaatagtgttgatgcaagatgttataaagatgtgaaaatccttgccttaactcttggtagggaaataaacttgctcacattattttcaagttcactatatttattagggcagaaaataatatattttcagggaggattcaactaacagggtttttacttaactctgttaagcagtaaattaaatgaaccagaacattttaggttcatcctggttaattgagggattattgtatatttcacagtttcaatataataactggctttcaaggtcattagattagtagatcgagagcaggttctcagcaaagtggagttgcctttatagatcattttagcatgtcgactaagagctggaaaacaaaacataaagataacaaagcctttaagcagcatttggaatagaggaagctacacggggatttgaaccactatgatttaccctaggcttggagcaggtatgttacttcatgtaacgtcatttagttttcacatttgactggattataaactgctgaaacataaggactgaatctttcaaaatttgatctgcagtttcaagcacagggcctattggaaatgggaagctgagcaaacaattcctgaatgaatgatcaccaaggacatcatttcataaaggttctaagacttttgatatgaattaaataatttgcttggaaacactggaattaggaatggtgtggttccaaaacatactctttccactgcaaaaaaaaaaaaaaaaaaaaaaaaaaaaaaaaaaacataatatgttgctactctcaacaaaggctattttgaaatgtgataaaatgtgatagctcctaataaagaagacaatatgttaaaaataaaataaagaagctattaatacagacagctatcaagacaggtgttgcttgataattttcataccactgctagccatttgtaacttgatgaattctaagtattatatattcctgaaagattcctggaagtggcttcactttttaagtaattatggatcaagtggcctttttctttttcttcgtgctttaaaatatgttgcactcttaacatccccaatccctgtggacctgaaaacttactggaaaagagaatgctagttttggtccgggcacactggcttacatctgtagtctcagcactttgggaggcccaggtgggcagaccagttgaggccaggagttcaagaccagcctggccaacatggcgaaaacccatctctacttaaaatacaaagaatagccgggtgtggtgctgcaagcatataatcccagctactcgggaggctgaggtacgataatcccttgaacccgagaggcagaggttgcagtgatctgagatctgccactgcactccagcctgggcaatacagcaagactccatctcaacaacaacaaaaaaagagaatgctagttttggattgtcttaatagtcatgatttcaaaaataattgataaaattttattatttatgcattttattgtaccaaaattgaatcccttatttggccagatgttactcatcatttcaaggcagagttatgcctttatgaatttttcaaaatggctgtaactgagaaaagctataggcgatggttaaaacaacttattttaatggctctcaggctttcaaagaccttgctatttcataaaggcatttttaatcaaccccactattttgtttagtttttccagaccagaattttaatcagcattcagctgtattgaatgtagtggcctctggtgcgggcaggtcaaacaagatactgattggttcaatttcatttagatgatgtcagattagaccaattggaagcagctttaagaacatttattttcccatcaaaggaactaagataatgtcctgcttacttaggaccctctaaatgcatccaaaaagaatgtgggcaaaacaaaataaaataatttgcaggtaattctgttatttcagcagcctctttataaataatttcatttacaagaaaaatgctttcataaatgccttacattcttaagagatttctttgtcaagttactggtttatggatctcagatgacatagtagatgaaacagtccttctaaaccaaaggatgcttttacttatcctagaagacatcataaaatcctcaaagtaaattttaattcacactgtgttttaaaaatatatacttatatgttgtatagtatagaatttatttggggagagttagcaggggaaatattttagtatacaaataagaaaaaaatagtgacaagtagactatcagaattaaatcccagtgtgttacaagtttaacaataagaagctgcaacatttttcccttctaaggaaaaaaaatctgaaaaatgcaaatggatggattttttttctccctgagaagtgggaaaaatttgtctttgaccatttttcctttgataactcagctgtctcatatggcctcttttcctgccatattttctggtggacttttagcacatttgaaatgtctggggtcttcaactttttttctattttaatcgttgggcaattattttttgagctcacagtgacctgtcctaaagctttgagtcagagtttggccacatttgcaaagattccattctctagaggagtatggtttttttcttgcacagaaaggcacatgccacagctgagaattagaggaaacccacagaggttaattaggtacccaatcttaatgcaattttcatgctcaggccacaatttaacccatctgaaagttgcttaattaagctggtaagaaattatcctgaagacatgggctattgctatagtcttgtaatagcaagtgagattaatttccatgtttgttgaccataaactgttgtttatgcttataatgaagaatttgcaactagttgcaacaactttgcaaatagtagtgtactcccatatttaaaaaaaaaatctaaaaatcagtcagcttccttctgtctttggggaaaagaatatcgactactttaagaatcacaaaatcactcactcagtatcaaactgaaaaatcagagagacgcctaaagaaagagatgctttaattttttatcttagtaatatctgtcttacacaaaaatgagctaaatatctctgcttttttacattgtcttatgattttgctttattttctttttgattttggtaaaatttagtgccttttgaaagatttttaaactttgttgtatcaattgaaattgtaacttgaagagatactgaaccaagcttaagtatagttttcaaatatcattgttatataaggatataattactaatatttgctagcaaatatgggctgaaaaccccttaatgtatttatcaatttcctggagaagtgcttgtccagtaagtttaaaacattatttgcagtttattatgaaattgcacacggaagtttctgtaacattcatgttaccatttctgacattagtgatacttaattagggaacagagagttctgtgatcatgttaaatttgtcaaacatgttttaatgaagcctatctactctgacacataagtaaattatgtgatcctttaagccattaaacattcactcaaaaattgctttgtatttgttgttttatgagaaacattgttttatttaattttatttggtgttatgctataaacatattggtcacactgtagaaataaaaggcaattgtatttgctgcacatcttttcttccctagaagtcagttgttttgtcttaaagtagtcttcatcctctagtactttacttatgttatgtgtacacatgctgtgtgtgtgtgtgtgtgtgtgtgtgtgtgtttaattcactctgggaacctttgtgcaaggctaacttcagcagggctgtttatccagtcaatatatgccctacatctctaggctctgacttaagatgcttccttaattcatacattcataccatctcagttattctctaactattggggatggctatcttatgtcttaaaaagcaaattaaataaatgttaaatcttaacactgaaatgaatttattttggggaagtaaaggtagcactatataacaaaatctgaaactcttattatgaattctctttcctcaatgttcatgaaaacttttgggaccaagagtgaaatgagcatttttgcatctctgtttaggcttgcacaggtggtgggtgcacagtgagtgaggccagtgaggccctaactgacgaggacatacccgaaggcgtgccagcccccaaagcccactcatattcacctgactcctttaatgtctcctggactgagcctgaatatccgaatggtaagtgaactcttttagcctcaagttaaaaagatgattagcaaaggtaaattaatattctaaatggcagcttatatgtggtgcttaatttttaatgatcattttagcacataaaatacctaagatagtatcattgtctctagttggggagattgtggtttttaggctaacacacaattttggtggctcaaaagtgctcccttttgatagtttttgtgtactgcatctcattgtttaatatgctccaggagaggtgaagagagcaaacggggaggattcccaaagaatgccgtagtgagagtgacattgtattttcaatgactttctgtttttaaaagccattagttcttccttggcgaaggagagaggtggaaagttcatgtacatattgtgtcaaaacgcttttgatttaataagtttatcttaaaagaggccacttggaactctgtattttttaatatactatttataaatatttcaacatgctgtttttaaacaatgcatagattaaacatacatatatttatacatatttagctggaggcaagttttgtgcatttctaagcaatatatatgtttttgtacagtttagtgaattaagctagtcagttacgtttcactaaaataaaatctcattatgaagaatttgtaatagttttgggtagaaattgctttattcatttagtggaaatatctttaaggttcatataacatagtaccattgtttcacactgatggaagcttacttgacattaaatttcattcctctttgagacaaatatcaagaagacttttaatatagaaactcttttaagaaactcattactgaaaattgaaatgggctcttttagcacagccaaaaagaatgaaagaaaaaagttacagttttattagtttgtcttatgtttactatgatattaattattccagccatctcattttaattaaacttttggcaaatgcactagatatatttgaggtaatggagagaattctaataatcagagtgaattattatctctgctattgaagttattcctgtactattacaaattttccaagaaaaaataaatggatgcctatttgataccatattaagcaatcaacaatcttgttatgcttcttacttcacaaagtaccctagttcatagatgacaatgaaaatgttaatgatttatttcaattggattgctgtgaaatgctgttacatgatttgcatagtagagcacttcccttcatcccaattggttaatacaactagaactacaattgctctcagaatcttcagctgttcagggaaacattttccacattacaaagctctttgaatgttttgtgtatttgcgtatgttttgtatatttgcaagcagttttaaaatgtactcatcaagcaagaagaatttgggagattttggagatttgtattgacacttccatggtattccaaagtcttgtgtttaattagagtgggatttttagaactttaattgtggtacaatggttagacatttaaaaggcagttttattttttttaaaacgactttttttgtttttactacttctccccactttcccccaattttttagctttttgtttctcttgttgattgtctagagagggataatctgattgttggaaaacatcttgtctctccatctgtcttcgaagtccccacacctctcctcaaatacccaaagaataaagtctaaattttttagtctggtattcaggttactaccaacttgtgactcaacctgaatacacattgccttataacatatcttcctttctagccatgctggaatatttatggcttaatgttgggttggaaaacatgggtggagtcaaataggcctagagtcaaaaattgtttctgatgtatagtgactgtgttacctcaggaaattcattaacttccatggaccccaatttccttgattagaaaattgagattaacaggctgggcctggtggctcacgcctgtaatcccagcactttgggaggctgaggggggtggatcatgaggtcaggagatcgagaccatcctggctaacacagcgaaactccgtctctactaaaaatacaaaaaattagccgggcatagtggcaggtgcctgtagtcccagctactcaggagggtgaggcaggagaatggcataaacctgggaggcggagcttgcggtgagccgagatcacaccactgcactccagcctgggtgacagagtgagactccatctcaaaaaaaaaaaaaaaaaaaggaaaattaagattaacaatccctgtcatcaccctgtccttacctgtagaaatacaactcattcttctaggctaaccgtaggcctcttattccatgaaatcattctactcttccttaagtttaaagtaaactttccctcttctcttgactatgtgaactgtttctatgccttcataatggaacttcattcagcctgtgcttaaagttatttgcgtatatgtcaaacactcccaccagatgctaaggaccataaatcattaatttctctttcactccgcagagcctaacacaatgttctactttttattggtacgcaataatatttaattcatttaatgtttcttgtggaaattacctttgatcagtggcatatatactccaaagccctggctctttaatgataccaagagagatgatagaagtacttaccatccagtgtctgcaatatatttgttcaaaatgcatttgttcctaaaatatatttttctagctgtgtagattctgaggctgggtttctcttttgagaataccgatcttgcatttgaccaaagaatttttaattttcttttctggattatgcccaattcaaagttaatggtaccaggctcacatggcaatatatgctacctaatggttgctttctaatttctgaatatgctgctgaagagaaatacaattggagaataagatagacttcattcttgtgtaactaaataaaccctttcaaaagattttaaatggtatttctcaaacttatctgattcttagaacaatcttgggagcaccaattgaataagtagattctaggctccaccacagacctcctaaataatcagaatcttccactgcctcggttatcatcaaaatacccctgggtatttactacattttccaactgagacctctcacaaaatcctccccctggatttttgttacatcttaaacccagcatatccaagttgatttctcctcatggtctccatctctctgcttgctctttctcctgtattccctctctcatggatttgcaccacccagccctgccagccagtatactgggcagcagtcttcaccttaaaccttgctcacccctgactgctgtcaccacacaacccctcgactgcacttctctagtgaaggccattaatattgctcacccagatcgcttcaggagcctcctcatgccatgcaaaaaatttgcatttgttcattcaaaatatgtattttgatgacctactaggttccttcactcttatctatacagtgcatttccttgcttcttgatctcaaggatatcagagtcctcggggaaaatatccatataaatgaattctcacaaggtggggaggtgcacaaggtgccaggtacacagagaagcagctcctagtggttccctatgagatgtggacatgtcatccctctgcatcctcacgaagatgttgcaggaccagatatagacatgtgtttagtctgaaacaggtattacttgcctggttttgcacactcaggtttcaaaatcttgactctgttaatcagttatgtacctaaaggtatgtttgttcactagggatttataaacatgaacaaagacttgttgagaaaaattaaactcaatttctataatgagaactaggtatatttttatgcttgcctatatatgacaaaatatgaaaggtataaaaagttctaatataaatgtccagtccttgccaatcaaacaattggtagcctttggccagcgtggcttaggaaacattctgtccttgtcataactgattctgacttaaatgatcatctcctactcgtgaaagtctgatggtaatccttaaccaatgctttaagaaaagatcctctccccttgttatttcagttctcttccttgtctcccagcctggtcctgctccacagtgtctgtgctggaaagcttgctagttggttcagtacatacttcatgagccctgagaatttttcctaatttggtgtcttttgttcagcagtgtaccagcagctccaagaatagtgcctgagacataataattgctcagttaaaaaattgttgattaccattattaaagaaaaaaacagaaaacaacatgttctggaaaggatgtggagaaactggaacccttaaatactgttggtgggaatattaaatggtgcatctgctatgaaaagtagtgtagaggttcctcaaataattaataatagaattattagatgatgtagcaatcccacttcttgaaatatatccaaaagaattggaaacaagatgcattgcagcattattcacggtagctacgaggtgcaaacaacctaagtgtctatggacagataagtagataagcaaaatgtgatatatttacacaatggcatatcactcggccttaaaaagaaggaagtcctgtcatacaatatgctctggatgaaacttgaggagattatggtaaatgaaataagccactcacaaaaagacaaatactgcatgattgcacttacgtgagtttatctatagtagttgaatgcacagaaacagaaattagaattacggttaccaaggtctgggtggaagggggaaatggagagttgctgttcaatgggtttagagcttcagttttccaagacgaaaaagttctacaactctgttgcacaaccacgtgtatgtagataacacaatggtacacttaaaatggttaagatgcccaattttacgttgtgctttttactgtaataaaaaaaagatacagagaggatgtaataaaatgctataaactaaactagaaaaaaagattaagaacagtgttagtttaaaacaaaaaaaaattgctgattaataatcacatagagatctatgcatgaagtatgcattttttaaacaagggtgagctcatactatttgagttgttgtggaatttacttttctcacttcacaatatggtgcaaacatctttccttgcagttcagtggaacgtgacctcattctttcaaaaggcagtatgcaatcccactgaatgaaactacagcttacaagacccatctttttattgatggacatttctgtggtttttgctattacaaacaaggttacttgctattaattgcctcagtctgccaagtacagtctttaagtactgagtcattatcacttgattcacacctaaggctttgcttgccttcaaatatgtcctgcttaattctagtcccttgcttcacatacctgcaaaaatgatggtgtgacactccagctctgtttctctaatcagagtcctttgcacccacgttccctctggcaaaggtgttctttacaggctgtgatttcagacatgattttaaaaccgctgaaaagagcgacttttaggtccaaggtctataggaacccttattatgtaggaccttgacgcttcctttgtaagaccattagctatcacagagaagtagcacaaaggattactgtctaatacatttgtgacctgtattgtgtagattgcaattgcgtaattaaagttctgcttttgagagcttccaaattctcatgagccatattcctttttagaagcttaggccttagaatcctgaaatatgttttttcttcacacttcaagtctaccttgctaaaacagcatagctatctgactatgccaaacttattcgtcattatctagcataacatttacagtgacattttaaactaattagaatatgtgttttttttaaatactaactaaaaatatagaatataaaatgtttatcttttattaatagctataattccttgtaactaacctctatctttacctaagtaaatcgacctaaaatagtttctttattagactgagccccatgagggcaggaatcatatgtatctttttcactgccctagtcctggcctttggcagagtgccacggagtagaggcatcttataaagctgtcgaatgaattaatatttaccgatgatagggacaataccaaaattgtaatagtgttgatgtgagaagcatattcatatgcaatcatacaacatacacaaatgcacactgtgagcacatttgatgattatgtaatataggtgggatgatttcaaagacagcagagaggaatcttcctcttggcctgctgaaggcttaaagcacacacttagagacctagtccttttgcttaagatttcatcagcctggtaatctgtagatttcctaatgaaagacagcacatagacttgtcttgtttgtgctctgcatgtctcagtatgaaaggatatgtttttactgtggtcaggatttgttaataaccacatgggcataattaagagagaagcatgtggctgggcgtggtggctcacccctgtaatcccagcaatttgggaggtcgaggtgggcaaatcacctgagcctgggagttcaagaccagcctaggaaacatgatgaaaccctgtctctaccaaaaaaaaaaaaaaaagaaaaagaaaaaagaaaaaaaaaattagccaggcgtggtagtgtgtgcctgtagtcccagctacttgggaggctggggcatgagaatcgcttgaacgtgggaggcagggtttgcagtgaaccacaattgtgacactgcacttcagcctgggtgacagagtgagaccacgtctaaaacaaaaaagagagagagggagaagcatgagagctgggcacccattagacatggtctagcatcttcttgagaagtgaaggggacctgagaagcttatggaaatattttcctaatttagtctttcatattggcccatctttgtgagaatttatatgtgaacatatgtcaaaatggtggcaatcatgtcaaaaataatagaaacatcttagcaggttgattatttttgtagacttacacgtagtaccttgaagacaatagaacgttatttaaaaaaaacatttggctcagtgttttgagcttatatattctgtcaataatgggtggtagagaaatcaattaactataggtctcttatacacactctatacatgttgtccttcacattaagagatgatgctatagaaataagttttcataatgtatgcacatgaagatatatgtataaatacaaattaaatattctatgcatgcatagaaataaatacttgatttcctgttaacaataataacattagtaataataataatagctataatttataagaatttgccaggcactttaattcccataactagcccatgaaataggtattgttatctcacaaatgtggaaacttagatttataagtattaaacagtttaattattcaaaatcaagacagctggttaagcagaaagattgtataaatcaaagcaaggtgtgaatgacaaaaattcacggttttattcactatattatctgcctctactttttgtagaaaggcttataatgtagaatttaatctagctgtatgaaaacaaaattttgttacttttacttgttcaatgtcctgttcttagtgccaatatttaaaattcataagatctgtgttctggtttttctctggttttggagagataactgtttgatatttcatttgattttcttactttttattttaaaataactttatttttaaatggtcaaaatgtgattctattttctttcctggaaatgctcagttttaataagtgaaatggattatagaactcagcgaatcacttaggaaaactgcttgacagttttgagcaaaccttgcgtaacttttatgaaacacctccagtcagtttgtcaggtagaatttcccaagcacagtcttttttagattccgttgattccatttttaggagagcataacagtaataaggcattatcccgcaatgtgaaagctcttctctcttttcctttttaattgaaggatcaagtattcacacagggagatatctgccacattcaatcagcatctggaccttgaggggagccctcagttcatattcctattgccatgctgcactggaaaagacaaacaaatatgtttggagcatctatattcactacacatgttatttttatgacacactaaagcattgttgtttaattcttacagtaaacacaattcttcagcgtaaatagagataccttgtattaaatttacattgtattgtacttgcattgaatttccttggttatatatgacaacctattgagcaccttaggaaatacaatttgacataacatgatgaagaggcacaaagatatatatcccagtggatatgctttatggacaattatcatccagcttccctgtgaaaattaaacaccttaaaaaccctatcattatggaaacagaaaggtgataaacttgaaactccttctgttgtacagccaatgggaattaagtatccattttgtggattatccattgaagaactgaatgtctagaactagattaaattaaactgaattaagccagaacctgaccccctttgccacatggcatgttacagttttattttgcttcagctgtcttactgattattagtgccagagaataagcaagaaaaagcctgaaaaaatacaatatggtacaatataatagagtaagtgattttttatggtgaatatttctcttttgcttttctagattcactctttttcaactctgccccgtgccctgtaaggctgaaccttcctcacagtggcaatgggcttcctctctctctggcttcctgttggtttgtccatgggcagcaacggcaaaagatgagagggtgagaggagcatggagtctcagaactcattctccctggctctctttctgcatggctctggattccagggttgcattcctccagtaaaggctacatttcctatttgaagcctctttctttctccaggttcctgaatttgttctcaccctttcctctaaaaacataaagaagtttactggctcctagccaactagttaaaatggtctaggaatcttagctagtactagctgggaatgctttattgtcactggttgctttcccttaaccctgtccgcatctttgtaaataggagttccactaaaatcttttccatgccatttgagttgtcattggtttcctgttgaaaccctgactcattcctaaattttatttaatccacatttaacacggagaggtgttttttgtgtgtgtgtgtttgtttttttgatgggggggtagtgcgtgaagataaatttaaaatgactttcttcatgctaagagtggcaagaataaataagtaaatgaacaaaatttccattttcttaaactttgtttcaatacaatagacatcttaaaggccaataagaagagccaagctcaaagattctagtggcggcttgcttatctaataaacccatcatatttaatttttcaaataataatcaacttattgatatatctttgaaagcttttcacttattgttataaaatatttctttgttatcattagtgaaataatggcttatgacatcttcctcttgatgaagtagctctgagtgccaagtttagcttataggtcagtttcggccaggcgtggtggctcaagcctgtaattccagcactttgggaggctgaggcgtgtgtatcacctggggtcaggagttcatcaggagttcaagaccagcctggccaacatggcgaaaccccgtctctactaaaaatacaaaaattatctgggcatggtggcaggtgcctgtaatcccagctactctggaggctaaggcaggagaatcacttgaacctgggaggcggaggttccagtgagccgagagtgtgccattgcactccagcctgggcaacaagaacaaaactccatctcaataaataaataaataaaattaaataaaaatcaaggtcagtttctcagataagccctattacgtatcctacccagactaggttagcatccacctctcccttctctatcccatgttttccttctatccatctgatttttaaaaagtaaactttacatcctcataatacctctaatgtctgttctttcgcttagattgaaagttttgtgaaggaagtaaccatgactgttctgacaacttctgtattaccagcatgcaacacaatgtctggctcatagtagctaccccatagttactgatgagccagatgactaccagaaaccaaatctaaatccagcagacttacaaaaattattttacagtatttagtaaatacttgtttctttgcactttctggacttcattggaaaggaatgaattttaaatgaaaagatagcatacaaatataagaaactattggctaatgacagatagtgtgccacggaggaatacagacctgcctaagcttgtttttgagagatgttagtttagtttttacaagagaagtgcagcacatgacataggtcagaattggaggagatagtctaaggtgagcttcctatagcaagtaaaactttaactcatactagaagcaaggggacagttctgtgtgtgtcccttctatgtgcacagtgcttattactaaagcacattcatatatgctcacttgtttgattctcagatcaactgtcaggccaccagggcaaggaatattaccccattttgttggtcaagaaatgaaagcttagtgagttttgctatctaaccaagttttaaaggtacgtggtcatgacagaagggctgaagtggttggaggaagatccctgaaaaagaagacaattggcttggaagcttttgactttgttttgaaatagttcccagaacaggagacgcactcaagaactaatttgttgattgaatgattacttacgtaaatgtatatgcacaaaattgatacttcaaaataattggccatacaatttatcctgttctgcaacttgctttttttctctaattcacatggagtaaacatctttttatgtcaatagcatagtgctccctcatttttcctcaaagcttagtaaaatgccattgaatgaaaccacaacatttatagaggctatctggtaaatgattaatatccattccttgctacagctacatctcattaatgccagctaaccattaattataaaagatgttgacaataaggtttggtgcttggactagtagatagtcctcaaatggattctcatttatttggatttggtatactccttgaggtagtgttgcaaggagtgtttagccaatagttatatcctgaggagtcctcaaggcctgaggagaggaccctgaactagctgttaagcctcctcctctaaaacaaagtcaaacaacagggttgaaagtcaaagaatgaaagagaaaagaaagctgatgtgcctattttaatatcagacaagactttacagtgagtagtattattagttataaaaatgtagtttcataataataaacgagttactaaaattaacatttattttttatcaaaatatactataagggcccacaaagataaataataagagagatgatatttagaacacatgtaaccatcagaaaactgtatccagaatatataaaacatgcctacacatctataacaaactggagttaacatctgaaaagtcatttcacaaaagaagaaaaattaaatgtctgataaacataagaaaatgggccaacttctgtaataatccaaaagtaaaagataatacccaaacaagataccattttttacatctaatactggcaaaaatttcaaagtctgacaataaggtctttttgaggatatagaacaatgagaactcacatggactcacatgtacactagaattgacatactttcaaaaagagatgagcattgtctagtaaaattgaacatatatcaacaattcctctccaggacatttgtcctagaaaatttgtgtatgcgcttcaagacacatatacaaaaatgtgtataattacattgatgtcatagccaaagtataaaaacattctaaatatctatcaagagtagaataaataaataacatttgccctgtaggaatactacacagtaatgaaaatgagtgaagtatggctactctcaaaaacatgtatagaacacatgaatatcatgttacacaaagcaagatgaaaaaattatatatacaacataactctattaatataagttagaaaaccatgagaaacttaattatgttgttaagggatgcatttctcagtagaaaagcaaggacatggttcttcaaaagtcctcatatttatctgtgaggaagggaaagggatccaattatggacaggagatttctggggtgctggcaacattctattttttcaacgtgagtgatggttacatggccttttgcttttaaatttgtcattaaaatagaattgatattgtatatatttttatatgttatgttttattacgtgatttttaaaatgtagaaagaataggtatatggaagccgtaaagttgtatgcactgtagagtctgaatgcttcagtgccgacacatagctctaccacttcctagctgtataacactggccaagttaccaaacctctctaaaagcttttcttgtcatctatttctctcatctaaaatagaacccattccactatcaagagtttttcctgaagattaaatagtacttgattaaaacgctcaatccagtgattattgctttagcataaacttctttggactttaaagtgtttgtgtcttcttacctggcatgctcccctgcacaacagtattttttaatttaaatattttattttgagataattacagattcacaagaaattacaagagacagagattccatgtatctttaattcagtttctcccaatgtcaacatcttctaaaactataatacaatatcacaactaagattttaactctgatataatcaagacacagaacaattccatcacaagacatggtttcttcttatcctcacactgaaaaacaattccctttttaaccaggaacagaagggtaagttagtactttggaagtaggcttttatgagattaacgtcattgttcatgtttgataaaggaacactcttttctgaatagtgattttatcataccatattgcaatctaacacattccatccctaagtgtcacaagttttttttttaattaaaaagaaagtatatataactgctaaagatatttcttctgccacagactactgctgaaatgcagcattcccacatccctgcctcattcacgactacttcctatacattcaggaaaagacgtctttaataattatttttcctgtttgatatttttaaccatctcactgttactacctgcatgggcttccctactccagtctattttacatgtgattctagattattttttctgtatatgactttatcttgtcgctagtcagttcataaaaacactaatggtctcctgtgcatcataaaatcccaactccttgtagtgtcattcaaggccccaaattccctttgaagttttgttttctattagactttatcgagtgatatggtttggctctgtgtccccacccaaatctcaccttgaattgtgaaaatccccatgtgtcatgggagagaccccgtgggaagtaattgaactatggggggcatgtttttcccatgctgttctcctgatagtgaataagtctcatgagatctaatggttttataaaggggagttccctgcaaaagctgtcttacctgctgccatgtaaaacatccctttgctcctcctccaccttctgccatgattaggaggcctccctagccatgtggaactggggagtccattaaatctctttcctttataaattacccagtctcaggtatgtctttattattagcatgagaagggactaatacatccagctacaggaataacaacagattattgatctatttgggatacctttactgaaccttgcactttcttacttctaggcagtggcaaatgtcattttcctcaccagaagcatcttcctgagacataggtatttcacatattacctttcatgggagacttagcttcatcatatgacttattgaagtccccactaccgtatgtggaagacttgactgctctaaaaagcctgtaacacttctttagccagagtgattattccctgctagagggtcctgtacctactgtctactatttaattatgtcatttgtttggcataaagttgttgtggtgcttatgatccttgtttaacccttgaattgttatttaattatacctatgtttaactcttttcttacttccataaaggtagatattattcttattctgttcttacttcccaaaataccaagtatagtactttgcacttgattgactttcaatatatttatattaatctttttattaggcttatcttgattgctttgagaaccagagcatgttcaccagttcttaattcaagtgaaattcctaaaaattttagaagaggaaattagaccagaaacatataacaagagtagtgaccagagtggggtaagatggccagtttccacaactaaatttatatttgtatggccctgtaaaatgggttagcccctctaagaatccattccctcctctttacagcaatgacaacaacaattcttattttttggagttgtcagtgttaaagaaaataatgcataaaagcatgtaccctattgtctgtctcaaagtaagtgatcagaacattttaattttcttttttaagaaaggctctcactttgtcacccaggctggagtgcagtggtgcaatcatggcccactgcagcctcgacctcctgggcctgagtgattctgccacgtcagcctctcaaatagccaggaccacaggcacatgtcatcatgcccaactaactttttgcattttttgtagagacagggctttgccacattgctcaggctggtctcgaactcctagactcaagcgattcacttgccttggcttctcaaaatgctgggattataggcatgagccaccatgcttggcctgagcatattttaaattactttaaattattttgggctggtggcagtggctcatgcctgtaatctcaacactttgggagactgaggagggtggatcacaaggtcaggagttcgagactagcctggccaatacagtgaaatcccgtctctactgaaaacacaaaaattagttgggcgtgatggcgggcacctataatcccagctacttgggaggctgaggcaagggaatcgcttaattcgcctcctgggaggcggaggttgcagtgagccgagatcatgccactgtactccagcctaggctacagagatagactccatctccaaaaaaattaattaattaatttaaaaaattattttaagtattctataattttgaaaatacttacatggcatttcaaggactcaaaatcttactttccccagagctactcataaatcaaaactttgtttaaaataaatgaaaacagaggtacaacataccaaaatctctgggatgtagcaaagacagtgttaagaggaatgtttattgtgctaaatagctacctcaaaaagttagaaagatctcagtttaacaaactaacatctcacctagaagaacaaactaaactcgaagctagcaaagattttttttattactgattcaattttcgaacttgacattggtctgttaagggttttaatttcttcctgattcattctttggaagttgtttgtttctaagaattttctctgtattttctagtttgtgtacatagaggtgtttataatagtctctgaggatgtgttttgcttgtttgttgttgttgtttttggtaggaactgcctcccctaccccgccgaaaaaaaagaaaaaaaaaaaaactggaccaggtggattcacacccaaattccaccagatgtacaaggaagagttggtaatgattctactaaaactgttacaaaatatcaagaaggaaggactccttcttaacactttctatgaggccagcatctctctgatagcaaaacttgtcaaagacacaactaaaaaaggaaactacaggccaatattcctgataaacatagacacaaaagtcctcaacaaaatactagcaaaccaaattcaacagcacagcaaaaagttaattcaacacaatcaagtaggcttcattcctaggatgccaagtttggctaaacatatacaaatcaataaatgtattcataaatctccttgagttggaaatatatttaaaaacatgattcatcatataaatagaactaaaagcaaaaatcacacgatcatctcaatagatacagaaaaagctttcaataaaatccaatataccttcatgataaaagccctcaacaaagtaggcatcaaaagaacatacttcaaaataataagagctatctatgacaaacccacagccaacatcacacagagcaggtagaagctggaagcattctatctgagaacaggaacaagataagaatgcccactctcaccactcttactcaacatagttctggaagtccttgccagagcaatcaggcacaagaaagaaataaaagaaatcctactaggaaaagaagaagtaaaactatctttctttgctgatatgattttatgcctacaaaacccaaaagattccaccagaaagttcctggaactgacaaacaacatcagtaaagttttaggatactaaatcaatgtgtaaaaatgagtagcatttctatacaccaataatgttcaaactgagagccaaatcaagaatgcaatctcatttacaatagccacaaaacagtaaattcctaggcatacatccatccaagaaggtgaaagatgtctacaaggagaactagaaaacactggtaaaagaaatcgtgtatggcacaaatggaaaaatgttccatgctcatgaagtggaagaatcaataatcactaaaatggccatagtgcccaaagcaatttacagattcaatgctatttctatcaaactaccaatatcatttttcacagaattaggaaaaagctattctaaaattcatatggaacccaaaaagagcccaaaaagagccaaagcaattctacacaaaaagaacaaagctggaggcatcacattactcaacttcaaactatactataaggctacagtaaccaaaacaacatgatactggtacaaaaacagacacatagaccaatggaacagaaaagagaatctagaaatacagctgtgcacctacagctatctgatcttttacaaagtcaacaaaaataatcaatggagaaaggactgcctattttaaaaatggtgctggggtagcttgctagccttatgcagcaaaccagacccctacttttcatcatatacaaaaactagctcaagatggattaaagatttaaatataagatctcatattataagaatcctagaggaaaacttaggaaacaccattctggatgttgtccttgggaaagaacttatgaccaagtcctcaaaagcaattgcaacaaaaattgacaagataaacctaattaaactaaagagcttcagcacagcaaaataaactatcaacagagtaaacagacaaattacagagtgggagaaaatattcacaaaccatccatttgacaaaggtcaaatatccagaatctataagaaacttaaatcaacaagtaaaaaacaaataacctcattaaaaagtgggtaaaagacatgaacagacacttctcaaaagaaggcagacaaacagctaacaaacatgctcaacatcactaatcatcagagaattgcatatcaaaaccacaacgagtaccatctcacaccagtcagaatgactgctattaaaaagtcaaaaaacaacagatgctggcgaggctgcaaagaaaagggttgaatgcttatatactgttggtgggaatgtaaattagttcggccactgtggaaagcagttgaaggtttttcaaagaacttaaaacagaaccaccatttgacccagcaacccattactgggtatgtacccaaaggaaaacaaatcattctaccaaaagaaacatgcactcgtgtgttcatcacagtactagtcacaagagcaaagacatggaatcagcctaggtgcccatcaacagtgggttgaatgaaaaaatatgatacatatacactacgaaatactatacaaccacagaaaaaaccctgaaatcatgtcttttgcagcaacatctatgaagctggaggcttttgtactaagcaaattaatacaagaacaaaaaaacaaatattgcatattctcatttataagtgggagctaaacattgggtattcatggacataaagatgacaatagaccctgaggattaatggcagggaatggggagtaaggactgaaaatctaactgttgggtactatgctcactatctgggtgatgggatcattcacatcccaaacctcagcatcacacaatatacccatgtcagaaacctgcacatgaacccccgaatctaaaataaaagttggaaaaaacagctattgatacatgtcctgtgttctagttaaagaaaaaagcatcttcttaggcttcagtttaaaatgtccactacattatatttgttagtttttgttactctgtttaggaatctgaggtcaatgaagttaaaattgtcatgttaataggtgttttagacttaccgcttattaaaagtatgttttaaagctgaatcatacagtgttttatattatattgattttgtttatattgaaatcagcttaatatgatgtgtgtgtgtgtatcaatataatactagtcctacagtgtggttccacaattcatccttcagcccttcctccatatgctgtcaaatactgtttacctacaggatgccgggtaactctgtgtttgtgtgtgtgtgtgtgtgtgtgtgtgtgtgatctcacctatgttaaagttagacttcattctcatccacctctcaattagatacatcctggatactaaaaagtttttgagcagttgaattaactgtcacaaatatcacttaatttcattctcagcttatttgccatgtattcatcttagtctaagcccttctttcaataactgtctgctcttcctatatccatagttccagatgtcaaggttatctagcttctcaacatagattgctaagggttgacttactagagtcagatagacaaaaaaaaaaaaaaaaaagaagaagaagaagaagtaaatttggagaaactgtcactgagagaggatgtagaagaactcaaacaatgacacaagaattggtaaggtgcagtcactgagtgatgtttagggtaaaagctgggtaagaaccctgtatctcatcaatcactgaagcattatagaattagagaatgtagtctttggtgtccataatcaaagtttcagtcttcacaaaatgattcaattatattcattatattctgtgtgagaagacaggtaagtgtgtagaacttactagaaggatttccttcaaaagtggttaagatttttagagttcatacttaaggggatgagatttagtttcaatgaaaattaacttctataaaatatctcatttcccaatatgtcagataaatgagatattatgcacataatcctaacataaaagacattctctgttccccaattatgtaagaaaagggaactattgatttaggtactttgtatctcagttaaaaagcaggtcaaataggtagcatttcaagggtcttatggtttctttaagagattctgtaacacactatttgtacataagatttttttaggatcaactgactgcttcacagagagcctgacatgtaagaattttttggtcattgttattacctgatcatatcttttttccctttaaattttctatgtattataggtaggtggtgttttcactatgtgtctttcacttcttagctttaactcatttgtgtctttgtgtgtcaagtactacatagaattaaatcaaataccttccataggtattcataaagttaccatagatggtcacaccagaaataaagaaaaacagatactggcagccacatctttttgtgtgtttagagctataagtggtacctgagagtaaaataaaagatctttcccaaaaatttggaaataagggaaatggacttatcagaatggtaaactatacaaggttgtcttcttaaaggaaaatgaatcacagcagtggctttttaaaagtattaactcatttaacaaaaaatgctttaatcctaaatgaatgtattgtcctagatctgattggtataagagaaaacatttcagatattcaaaacagagggtattttatacaagtaggttgttctcaaggtgttgtaaagaagggctggaagaacaaaagggaaaggtggcaggtactggatggaagaaaaggatgattgacaggagctggtgcttactgctacacttgccgatttgacatttgaaccattatgggacgctgccccaaccagagctgaaatgccaacaacattccactaccgaagaggcagaaaatgcagaagagatgcttcttctgtctggaatgcttgaggctgcaggtgctttgtcccctgctgacacagcagctgtcaacaaagccctcagctcttggagctagaaactggacgttttctttcttcctgcttctgtcctcctcacagtgcctcccactggcaaaacccaatagaaggccaacaagcaagagagttggaaatgtagtttgtagtttgtaggttcagccgtacagaacaggctatagaagcgtggatgtgtagctggggcggacgtcagatgaatcaccttcttagctactcggcattcacacacacccttgtacttttcaccacctttcattaccaatagcaatcactctatgcttccaatgaacatgatactactatgctttgtacaaatgacggtgctctcacctccctcatcacattcttatctgggtgatgttaattccccttttagttcaggcacaacccatctggatattcttcaacataaaaaaactaaactataaattaatacccactaaccctatttacatgaatcaatggggaaaggaggacggaaaattggctacaatatacaaatctctgtgtcataagcagaaataaaatatgatagcatttataattcttgtttatataattagttgtgagaccatagctgatatttacaacttcttctctttgccctcagctggtagttcatttgtttgtagttcttttatttttattttttgtagagatagggtctctctatgttgcccaggctggtcttgaactttggggctcaagtggtccttctgctttggcctcccaaagtgttgggattacaggtatgagtcaccacacccggcttatttggaattttttacttaggccactggatcttcattactaagggggtctatgtccttcctgttctatcttgattgggttgctgcagattttcaatgcttatatgattggacctggtcatataaagagatgcccttttgaatgtcctgactgacaatgtgcagtaggaagccagtttctcctccaatatgataccttttctctttgcctgttataggaatgctatgaagagagggttaaaaagaagccaatgtgtaccaggtgcttagaacagtgcctgatacattatgagtcatatagaatgcattaacaaataaggtcgatttacttctggggcatatctattaagaatatcttcttttagaaagcaatacaaattataagtatgcttcacttattaatttttgatctggaacacacatgacaacagttaacaggatgcaatagaaagattctcatgctggaactgttgggttctatttctgtctctgtattaattaggtttacagtttgatattcaagggtaacatctattttatcctttggtaagagacagagtttagacaaggagaaataccagagtctgtgatttaatgattccatgaaactagaaatcacatcaagagtgcttgctttcttaagaccttctttgctattgtctagtagtcatactgaaaggcaattattatcttcccaggtgttatcacgagttatggattatatctagatggtatattaatccacaattcctcagaactcagctatcgtgcttacggatttgctccttggagtttacattccttcagagtccaagcatgcacggccaaaggttgtgctctgggcccactggtgagtatctaaatttacattctaggaatgtgttaaatgtcagatgacactgaatattaaggaagaagtaagtggcggtgactcaccctctgcacagctagcctttcaagcaggatgggagatttttctttttataaaagttcatttaagagttactaagattttatattcgacataaatttcaagactgaacataggtccagtgaagggcagagtctacattttattgaaagaaagataagttggctagtgtagtaggcaaacatgaaatttttcctaatttagtgacatattgaaggcagatgtttttctttctaatcatgggctcaacatctaagtaagtttaagattaagaagtaaaaataattgaaagtccataagtgccacaatatggcaacactgctccccaaaaagtaatcaattaaaaggttgagtttacctcatctgttaggataaaatagtttcatgtgatacagcttcataagaatggtatttaaaattacatcaatatcagcttttgatattcatatttcagaaatctatatctgaaatgtatatctatatttcattagcagttaacagcttgacaagattatgttttctattcctaatataatttttcaaacccaattaatagcacttaattatcataaactagcaggacagtcttcagtttcaaaacatcacattacactttggtgcatttttcttgattaattagattttgcttctttagatggaaatgctcattagtcttagatattttttggcaatgtttgctaatgccctatcattttagtgcatgctgtcttcactgaagagtatattatataaatattaccttggaagacagctctatgttttaatttctgcttccttatttttgatcacacctctctttttgtttcagagattggttgctttccaagcagctaacaccatccatcggcggagctgagctgtagtctttattgccattaagcattttatagcccagacccctctgatggatacttacccttaaatgcaggaatggcaataggccagcttttcttatccattcaaaaaaaaaaaaagaaaaagaaacaaaagaacacgtcacatgagattgaaatttacactttttgaaaatgtaagctgcaaatggtagttctggctacaaaattggctcagcggtgtctcctgatgttctggcaactttaaataagggggacctgcattatcaacctgcatcctgcacagacagtagctacgttaaccttaagaaatcaaatgccacaaagctctgataggaaggggggaatagaattgggttgtaaaacctagtctgccatggcttcattcattccagactcaatcctgacttacagcacagagttattttctcccttggtacttttctttatgctgtactcagtatgcaaacgcttttccctagtcaatgatccatctctaatcactgggattgaagagcaatgtctttatttagaacaagtcaactatatgctaccaagaagttaaagcccatggtcttcaactggtttgtgaaatatttttgtgcccattaagtgattccatatctgagtattctaaatagccctggatggctagcacaatcatgaaggatattacagattcagcttctttttgttgatgattcttttaatgtgtccttattgacttaagaaatctatgaatcaatcttaaaaggcagagttttctatcattaaattatgatgtgatactcaacaaaattcagtcaaacgtggcaatggtgtacaacggtttcttaagatattcatctaaatagagcccgatgctatgacattttaaataaaaaatttcattgaaacagaaaatttatcatttctatttttaaatattttgctggcagaaatcagaataaattttgaaagagttcaatttttttgttcatctaatatttcttaatgataattcttgttctttagattatccacacatgcagggaaatactattcaatgttttctatgaggaatatgcttcacagtcccaaatatgatatggttcatcctccaaattgcaaattgttcatataataaaaaatatgaatttgatggagaatttttaaaaataaaaagacatacagaagttccatattcttaccacttgaatgtagtattagctcatttttttttctaatctgaccagtttgttagctattatttatggttcagaaggagttgccctgtacctatctggaaaaaacaaaaacaaaacaaaataaacagcagcaacaacagcaacaaaaaaaacccacaatgattctcctgtggtttttttcagttcttactcaaccaaataatgtatttgactcttatggaaatttcaatatagaaaacaattgacaaagcctttgaacctaatttttagatgctaatgtgcattgtcaagttaaattcaataaattggggttttataaattttgaaataacataaaaattaacagaatgcagcaggaactttttaaatgctttccttgctttcaattgtattagagggaaacccttcacattttgtaatattctttaataaaatacaataatgttttccataagaaaatcactttgctttcttactccccacttagccaatgttacataacactagtggagtctaagattgagaattttatgactgtgtcttgtattgtaacattcattggatcgattctccagggactcttaaggatgatatgcgagactataggtcattgctatgtgatatggctaaaaagttgtcttggttccttagtgatgtcatacttatacagataaatacacctggataaatacacatgtacaaacacattcaccctttcacattttttttttttgcaaagaagcaaataagtgtgttatttaagacatctaaatcttaatggcaatatataatatagtcaagcaaacgctataggggaagtctgccttcaacctgcttaaaccccttaaatccctatacccccttaggagatatacttattctacaaagcctcagatttctcaactattacaaagagaaataatgtctactttaagagagttggtgtaaaaaattaaatataacttacacaaatttctggcgcattgcaagagttttattaagaataacagtttatggccaggcatggtggctcacacctgtaatcccagcatgttgggaggtcaaagtgggtggatcacaaggtcaggagttcgagaccagcctggccaatatgatgaaaccccatctctactaaaaatacaaaagttagctggatgtggtggcgggcgcctgcagtctcagctactccggaggctgaggcaggaaaatagcttgaacctgggaagtggggattccagtgacccgagattgtgccactgcactccagccttggagacagagtgagactccatttaaaaacaaacaaaagaattacaatgtattaaagtgtttgtatgttttattgcacatttgctctcaaatattttttctgtgtcaagagaggttcccaggccaaagccaagccaacttttacctttcccaagtgccttttccacatattccttttacagcaaggtagataaacaaaaaagtaaaatgaaaaagaaagaccaggtcagagcaaaatagtacaattgccaaattcaatgtatagtaaaaactgaagtgtttatccaaatatttaaggaaatgttacaaaacatatttattttgaattaaccaaatatttgaggattataatataattatctggaattgcccttaattcttcaacttttcaagtctcattttatttggaatgctttaaaatcattctatgtacaataatatgaactatatagataggcataataaaacaaattacattgtcataaaatattaaaatgatgaattgatatttttctggcctagtttcatcatttttgtatgtagctattaaactaaaaacgaaagagcaagtgttatagttctaaagaatcccatagcttttctctgatgaaaataaaacatgttgtgacctcatagttattaaaaattaacactttctttttcacatttattttcataattgataaggtataatcaccctaacaaataaaggttttctaattgataatatttctgcctaaggatttcatgtttgatcacctccttgggaggcaagagcttgtaccttaagaataaagttgaaattatcacatatttagtaaattgtgaaaggtcaaatatctatgagtgatgctgatgagtttgtagtgattagttaactgaatttaagctaatgattaaaagatattaaaaatttctgaactcttttctactttcttgccaactacatcttcctctgaccacttattttacttatttatctattgaaatcttcctgaccccggtacagctagggattgcattttatttcagagtctttctcttcaaataattcatcttttgctcttttctgcatagcttcattaacacaatcaatatttttttgtgattgtgccttagggatagagtccctaggatgcatgtatttcttaatgttagcatgatgccatttttacataactgatagcaacatagctcataaaaattttgcgtgtgtgtgcgtgcatgcctgtacacacatgtatgcatgcgtgtgtgtgtgtgtgtgtgtgtgtgtgtgtgtgtgtgtgacagagaagagagagagtcaagatatgtggtgtagctttttgacagaggccagaagtctaccacctaagtcaaggacttataaaaacagactgcgtgcatttcttctcttttgcaatcacataaaaattattttaaagcagtcctagaattggtctatggatatgtacagccataggcacagtcacagtgtgagcagatccacatattctggaaatcacaaatagctgccttggtcaagagctcaaattctaagctttaacagcagggggaagaaaacatgaggtgtgctttgatcctgctgacaaaatgaggtattcatacaagatgctactgtcaaaatagtttacttcacagcaaaaagagattctttgaagaaatatgctcaaagcgaagcatgtacttattttatttgcaaacaaaaataaatctttttatactcacaggtggaaaatcgaactctagaagctcctcctgaaggaacagtaaatgtgtttgtcaaaacacagggatcccggaaagcccacgtgaggtgggaagcaccttttcgccctaatggactcttaacacactcagtccttttcactgggatattctatgtagacccaggtaatttgtttttattttctaaactttaaataacattagaaaacaactcatttttatttaaaatctttcttttggctaaaatctttcttttagccacagatgttggtttctttattttcctgaaaataacctatacggataagctactgcccgacggttctcagaatgtggttcccagagcagcagcaacagccacatctgatgaacgcttagaaatgtacgttgtagagcttctgccccagcctagtgaatcagaaactctagaggctaaggtctaacagtctgtgtttaagcaaaccctttaggtgacacatgctgaagaactagtatatactcttcttcccttgctaaaaagtggttcaaacctaaaacatcgtgtatgcaaagagttgaactataattttgcagtccatcttaaacaagccatttttgtgactgttttagatttctgaactatcttagtaattctgctgtgtgttctgataaatttactgaatgtggattaggctacatggggttccttgaaagtattttcaaaaactatctgattcaataagttaggtgctatggtagcatgatgtttattttaagcaaactctaccataaaaagagcaggtatatattttaatagaaactttggatctgtattaagtgctgttgtttatcatcttccaggagtggccttactatttttgtaggaggaagtttgaacctttatttttaaatgagtagcaaatatgcaatatcgtggattcagtcagacatgttattagcatgttagtctgttgcttaggcttgaaaacgtttctttgtttctgaattttctatgagtctttgtaatacttaataacatcctccaagtgtaaaaacaggtgaagaaagaaaaaaacaggcttttctaaatttgaaaagggtggttatttgtgtactgcactggcaagcaaatgcgagtcaagtgcgtgtcagagtctaagctgatcccctcaaagattggtgtgtcccttttttatgcaatcagggctttcatgtattctgctgtaaagcacttgtaagattatgaggtgaaggagtgatgatcgatttgaaaaaagaagcaacatttaggccggacccatgacagcccagctatttccgccaaggcagctgggtgaataatgcaagagccatattccccctcgtgtttaatcttgcattgtttttgcagagaaaatttctgcttgccttctaagtcatgtcatcttcagttgtcatcccgtctctcaaaccatcaaaacggtattaaatgttgcaaagctgcgcggcaagagaactttcaaaagtcagaacccatttaccgaacagcccttgtagaaaatgtattctgttctcggcagaattttccttcagttctttccactgagaagtttactgatttctcccagtggaatctgctggaatttatcggttcatggttggcagtcacagattaaggtaaatgtcgatccgtaatgaccctctacatgttagtattgcagtaaagctgggcttttatgtcaaagatatcggagagggagctattacacatgacaggggtgatcaagggactccagaccaaggcaagcattattaaatattgactagttctgtgatttatgtagagctggaggaaaaaagtgactttttaaccattatatattcttcagcaacgaaaaccagccatttatctcctgctggtaataaagaacagagtgcctgcatattttagtggagggaaaacctggtcttataaatgagatgaactccttcgtgataacatttcagtttgttaattgccaaaagcaaaacagacaaattggaagcaattacgagatttgacttaaagaatttttgcggtacgggttcaactcaggggttggaaaggggtgaggttggaagcaaaaggagcatctgagatgggccccaggaaaattcgtgtcattggttcactggcactggaactctcatgtccactgttaactgaaaggattttgaatattgtcttgtcctgtcacccatcagcagctgggtgacatttacactgagggtagggaggtctgcatggctctacaagaacaaattaaacattaattcatcaaacttatttaagatatcatctgttcactagatttatacaaagcttattgaattgtctaatggctaattggttatttccttgacataatgaacaactgtatttcatcctttcctgtgatggctgctaaagagggggtggttagaatttataagatagggaaattcagctagttcaaagcaagtgtagtttcaacataaaagtgcctgcagctgggtcactattttgcaggagaaattgggctgtgtctgtaagacaccctcatgggaaccctattcttcatgtcaactcgtatcctgaactaaaaactttacaaaaacattaggtttcgtaacaacaagtgaagtggcacgtatcaaagtgtgatttttcttaaaaattgttcacttttgaccacgtattatgttctcatgaatcaaaatttaaaagatagaaaaaaaggaagtaaagtaccaagcctgttctgcagtctcagaggaaaagtagtgtgctcagcttcttatatccttctagaaatatttgtcttataggtgtgtgtgtgtgtgtgtatacataaacaaacacatatttcccccatttgtaaatacatatagttttcatctcacacatgcaacattttatactaatgataccaagtggtacacattattttgcaccatgctttttttccatcttaataatttcagagaaattatcacagcaattcctaacgagcttcctcattctttatatagcttggtaatattcaacgggttagagcataccatcattggtttaaccagttccttattaatggccatttaatttgtttctaatcttttattatttcaaataatgcctcaatgaataaacatatgggaatgtcctttcacactttgcaagtaaattaatacgataaattccttgaaatgaattgccaggtcaaggaaaaatgaatttgtaactttgtaagatactgtcaaatttcattccatagagaccatataatttatattctcagaaaaagtatgagggtgcctgtctccccacagtcttgtcatcagagtgttgtcagacttatctttgccaattcgatatgttaaaaatggtagctatttcacagtatcttgagtagttattaggaattagttggaacttatgaacatattttcttaagtttaaaaactgtgtttcttttttttgtgaatgcttcatttgtatcttttgcccacatttttacagaggtttaagaagttctttatatattaggaaaatctgttatattagtagaaatttttcccttcattattgctttttcctagcactctactgctttcttttataaaatatttatattcagttcatctgaaatttatactgatataatatgtcatgtatgggtcaaaccttattttcttcccagaaaattttcctttctctcaaaaccatttactgaataatccttattgttccccactggcttgggttgtcatctccaagagctcctaaatttccatctttattaataaatacgtgtggacatatctgtacctttatttacattatcaaggtatcttaatgattaaaactgtagaatatattttattgccttgtagatctagtcctcttcattatttttattttatataatttcctacttattatttcatatttatttttttcaaacaatatttatatatttctaattttaccccagaagtcctgatgctgtttttataaggatggaacagaatttacaggtgacttaggtagaattaatatctttatactgtcgggtttttctgatcaatgatatcattatactttctattttgtgtcttttgtgtctctcgcaagagctcaaagttttcttcatatagatcttgcatatttctgttgtgtattcattaatattttataattatacatgatttaagtaattatgataatatatacattttacatattaacattaaaattaaataactgaaaagagctactttcaataattatatgtagacttcactcgcagatacctgtcttctgaaagccacgattttaaatgtttatatctattagatgatcgttcatctaacttttacaaatatttgaagtttttttgctgctaagattattgtcattttctctaaaatgcaggcatcttaccaggggaaaatgataatctaattaattagactctcaactagtttgtggtgtgtaaaatggcaacaaaggttggacctgaagaatctctgtcctgacagaatttacaaataaaaaagctaaggcagacaaacttagccaagttattctcaagtgcatgaggcaggaaagaaactagatggtgtgacaagtggaacagaaataattaagggaagattttggtaatactgggtctttctctttaattatggatgagaataaactgaatatggaaaaactaaagagaatgacggagagagcacaaacacatgtgaatggcaaaaattaacagatcaaccaacctacacttggttatattagaatgtatttttgccatttgctaacatccaccataaaagtaaggattagcacttttctatgggattctacctgatttgaaacatctattcaattatgaggaacatatgatcaacaaattagtttttctagggtgtgcaagtgccatttactgacctggaataagtgctttgctcaatgactctcaagggtgcaccattcaccttgcacaggtgaatagtcaactcccagtgatcactttacaacatcttcagtattttttcacacatatgaattaactatcaatttaaattatagataacaggtttataatcattccttgtgaaacatattgaatatataatttttaaaaaataaaacaaatgtgtaagtttgggaatacaaataaaactttacagcatagtagtagcaacctggcttatgtaaaactatttataaaattataaattctattccatttaactggtagatgaaagtattgtgccatgataatttagggttacatcattattttacagagcttcaaaagtattctcagctacaaatataaaacaacctaattgtcaagaagaaaaataaaaactatgaaaagataaagaaaatattctgagatcctatagaataatttttacaaatggcagcttctttactactagacttcccttggattcttcacactgatcctgtacttagtagacaatgccatgtcttagtacacatatcctgcttttttcttaagtggttattgtggagtcctctgcgaattgtttaattcttcattatccttccttttgaatgaattgggacgtgatcttcattgcttgatatcctgacagattgctttgtgtcagagtttctaaggcaaggcaccagcgtgtgctaattgctgagtcctttgtgcactgttaactctcacctgctctgaaaaactggattgcagcttagttttcatcttcaaatgtctctttctcctaatcccctattttgtgctgtgccacagaataaagatatttatttgaaaaagagagatatggattactgtgggggaaaaaagagggtaaatgaaaatgatccttaagcattagcaaagggaaatggcattttagaaaaacaaaagaaaagcaaagcagaatgatcagtttttaatgttgaaactgaatcatttcatggatctcagataactctttctgaatgtggagaggtacaacaaacaggttttaggtgacttttcccagagtaaatatgtctaatccaaaataagtcctcaaaagtaagggtggaaggtaaggaccgggaaagaaaggaaatggaagatagaaagaacaatttttaaattgttaaatgctcatgaaatgagcataatcagatgctttttatttgcttataagacctgatggtcctgaaaaaaagaaacccaattagtatttaagaatgtttttaaaaaggcaaatgaaaatttgggaaatatatctgttatctctaggtggttatattatgaatggtttgtcttcccatttttccttttatatgtactcaacttaaaaaaaattctataatatatacatattatttttgcaaaacattataaaaaatagctcacaagagcagatgattcaagagcagagtaatttggagtaagcatggtgcttctggctccaaggaggagatccgggtggtgagtcagaagtcctaaggtggaagcttacagaaagaagggcatcttcacatatttccaatgattattcaggaaaagtcttttggtgacttgtgggatgttaaatttaactttcttcttatgttttggctgcatatgtttttccaacagttgctaggggtaatcaaacaaaaacaccaaggattctgcaaaacagaaaagaaaactaaataggagtggtcagagaaataaaagagcctctttatacctgagacataatggtagtgttaggggaggactgaggcatgggagatttggtttttttgaggttacattgtggggatcaggaggggcataaagtttttactgcagtggtaacatctggaaggagtggggtgccttaaagaccgattaggatatttccaggtagaaaagatagagtataaatgtgatggctccccatcccccattctctgagcctaaactttttcttctgttataattggagtccatatctcatttcaatattggtatcaagtgtttgctctttgggataaatccccatctaaaaacaaaagaaattaaaggggaacggaaactgcagaaatgcagaaagtatttcattgctggtttaaactagatgaaagtgtatttttaactacagttccgaaaaatcctagcacccagaataggcttaccttctcctggaattgccagttaccagaaagagtgctttagaatgtcagtatattcaaatgctctaaatctctaaaaaatcttgaaaaaccaaagaaatgcagttgatttttcaaggttacccagagaaatccagtgtccttttcacacactctggttctctgggtgcttttctccccagaatatactgtgttttataaaaattacaagatggaaaaaaaatatacagaagcgtttattttcttgagaaggtaaggaaaataattatatgtgggaacctcttagacttccaaagagtctgtaggaaggctaatgctgttaggaaagggacagctttgttttatagtccctggtatctgttttttagtgtggagggaaatctgcggtttcagagctgtgcttgcaacccatgcagtatatctgacacgctgccctctgggaaaacccgccagtgggggaattgttccagtgatgcagtacagcttgtaacttggaatcccgtcggagaactttgtagttgcttgtcagtcagtgggaagataaaagaggcagcttcttttcaagcaatctgaattcattttcccgtaatgagttagggggtcaggcagcaggagtgagttcacctgagatcttataaagtatatttcctggtggaagaaagagaggaggagaaaagggaacataacgtccaccacgcagctgtagaacggcgtaatgtggcttgtcgttggtctatttctttttatgcccacatattctgatttcagagcatatatttttagaaagaaaggtcaaagaaagtacagctttatctcatttaaaaatataaaacccaatctgtgaaaattgaaacccagttaaagtctaaagcagcaagtgatagtgtttcatacacaaatactcatcaagcaacaacatgttaaagatattgtactatgtcttctgacattacatcattattaaccacacaatttattttagagacttagaagaaattaaatgagtgtcatgataaggagttcttttagttacagacaacagccccagacctctcttcctgaccatttcagatgttgtttctaaatcagcacaaaagatattaggaataaaaactgtgggagaatgttcttatggtcaaagcaagtattaatataaaaaacattgggaatgtaggggaaatagagaaaattactctgtttctatttgtttggaagcaaatgtctcttatgcaaaaaagaaagtatagttattatatctttctgtaagtttccaacacatttctggatgtataaatacatacaaatctaaacacttgggaaatcaaaaggcattttttctggactacaaattatggccatattgttaatgaaaatataaacgggcaataataagatatctgtcatttcaaatattgggctatagaatgtatatgcactgaatgtattgacacttctgattgtatatcatgtcatggccaataaagctatagaaatgtttaattaggacatattcttccacaagaatggagttaagcattaatttatcaaacttgtttaagacctcatctgttctcaacactcacacagcagcttattgaatttgtctgatatctaattggctattttcttgacataatgaacaagtgcatactctatgctgttgtgtctgttgaggcggcgatgtaatgatgaaatggaaattgtaaccatgggtcgtacactgattcaggatatgcagcccacagagccatgagagggcacaggatttcattgtcctcatggcttaactttatgtttcaaactctgcagagcatctctgtggaggaatctctccattctaactcctcatgaaaggagcctgttagaagcaaaatacaatcagcagatcacccagatgatgtacctttggctttggaaggctttgcataatttaaaaaataaaataaaattctcctatttagagaaatttttaaagcatttaaaaatactcacaccattttcaaacccacaccacaagtgatttgggggatttctaatacatgcatgataaagttcaactggataagccagccgtggggcagatatataatgtttacctatagttgtgtaccactgatatgcctgtctagtgttggtttttgcatgctttgttgtggcaagagttcagtgcttgttgaataaatagtaatattagaatcagtgtttagattttggtagactgaacatatagccattttacctaggaggttctcagtaggaaagtgtcagctgtgaattgatgttagagggaaacagaagaatggattacacagagaaatagaaaaaaaatctagccatctggggccaatgtccttctctagcctctaagacacaccctacagcaaggaattcccttctctgattcctgaacttctcctgtgggaatctagggatcaacttccttggatggtgatgggtccttatcattatacagagttatgaggattacaaaccatatgtttggccccttagaaagtgataataggtgactcctaaatcatagttctatataccaagaacagcccacatcaaacatatttcccaaatttttgtgtgaaattcttcataatcaatgtgttactttactcaattattagtgttgcagaatctaaggattctagtgggctatttatgaaaaaaaaagtatatggcttttagagaatttggattctttatttataaatcgggttgcaaataaaatttatgtttttccttctagcaatatgcctttggggagaagcaaagggagttttacacccaagaagcagaaatcaaaaatcatagaattaaattaagaaatttatttgtttatttggacattcattcatttgttcatgtagaaagcatgtatctagcttgttttatggaacaagacagaaactaaatgatagctgctggagttgagtagagaaattttctctatccagagttgaatcatatgttgttttattgtgctaaatttgttagacatttaaatttatacgaatgatggtgcctgtttctgggatatttattccttcccattgtaaacctatttctccaaatcatcactatgctaacttaatcactatgctttcaacatctgaaacatttagaaagtacttaaatatctggcaagcatggtctgtgtgctgaaggggcttgtggtttaacaaggggagctagaaattacccaagtaatcatatagaaatataaaattacagactttaataattattaaagtaaaagtatatataactaagattttcataataagaagcttaatataaattggagggtcaagaaagtttctttgagctgatgacatttagggtaactgtaacatgactagacaccaactcagaaactagaaagaggattccaaagtgaatggcatttgtaaaggatgtgaggaaggtaaaattgtggtggatttgaggaaatgaaagaaggacattgtagctaggctagggagtgaagaaaagaatggcacagatgagactagaaagttagacaggagctacttcatgcagcagactgttttaaggactttggcataaagtaaaagtgtagttgcaataattacaaaaaattttcaaattttcaattgtttttttttattattattatacttcaagttttagggtacatgtgcacaatgtgcaggttagttacatatgtatacatgtgccatgttggtgtgctgcacccattagctcgtcatttaacactgggtatatctcctaatgctatccctcccccctccccccaccccacaacaggccccagtgtgtgatgttccccttcctgtgtccatgtgttctcattgttcaattcccacctatgagtgagaacatacggtgtttggttttttgtccttgcgatagtttgctgagaatgatggtttccagcttcatctatgtccctacaaagtacatgaactcatcattttttatggctgcatagtattccatggtgtatttgtgccacactttcttaatccagtctatcattgttggacatttgggttggttccaagtctttgctattgtgaatagtgccacaataaacatacgtgtgcatgtgtctttatagcagcatgatttataatcccttgggtatatacccagtaatgggatggctgggtcaaatggtatttctagttctagatccctgaggaatcgccacactgatttccacaatggttgaactagtttacagtcccaccaacagtgtaaaagtgttcctatttctccacatcctctccagcacctgttgtttcctgactttttaatgattgccatcctaactggtgtcagatggtatctcattgtggttttgatttgcatttctctcatggccagtgatgatgagcattttttcatgtgtcctttggctgcataaatgtcttcttttgagaagtgtctgttcatatcctttgcccactttttgatggggttgtttgtttttttcttgtaaatttgttggagttcattgtagattctggatattagccctttgtcagatgagtagattgcaaaaaatttctcccattctgtaggttgcctgttcactctgatggtagtttcttttgctgtgcagaagctctttagtttaattagatcccatttgtcaattatggcttttgttgccattgcttttggtgttttagacatgaagtccttgcccatgcctatgtcctgaatggtattgcctaggttttcttctagggtttttatggttttaggtctaacatttaagtctttaatccatcttgaattgatttttgtataaggtgtaaggaagggatccagtttcagcttctacatatggctagccagttttcccagcaccatttattaaatagggaatcctttccccatttcttgtttttgtcaggtttgccaaagatcagatagttgtagatatgcagcattatttctgagggctctgttccattctattggtctatgtctgttttggtaccagtaccatgctgttttggttactgtagccttgtagtctagtttgaagtcaggtagcgtgatgcctccagctttgttcttttggcttaggattgacttggcaatgcgggctctttttttggttccatatgaactttaaagtagttttttccaattctgtgaagaaagtcgttggtagcttgatggggatggcattgaatctataaattaccttgggcagtatggccattttcacaatattgattcttcctacccatgagcatgcaatgttcttccatttgtttgtatcctcttttatttcattgagcagtggtttgtagttctccttgaagaggtccttcacgtcccttgtaagttggattcctaggtattttattctctttgaagcaattgtgaatgggatttcactcatgatttggctctctgtttgtctgttattggtgtataagaatgcttgtgatttttgcaaagatactcctcgagaagagcaactccaagacacataattgtcagattcaccaaagttgaaatgaaggaaaaaatgttaagggcagccatagagaaaggtcgggttacccacaaagggaagcccatcagactaacagctgatctgtcggcagaaactctgcaagccagaacagagtgggggccaatattcaacattcttaaagaaaagaatttttaacccagaatttcatatccagccaaactaagcttcataagtgaaggagaaaaaaaatactttacagacaagcaaatgctgagagattttgtcaccaccacacctgccctaaaagagctcctgaaggaagcattcaacatggaaaggaacaaccagtaccagccactgcaaaaccatgccaaattgtaaagaccatcgaggctaggaagaaactgcatcaactaacgagcaaaataaccagctaacatcataatgacaggatcacattcacacatagcaatattaagcttaaatgtaaatgggctaaatgctccagttaaaagacacagactggcaaattggataaagattcagacccatcagtgtcctgtattcaggaaacccatctcacgtgcagagacacacataggctcaaaataaagggatggaggaagatctaccaagcaaatggaaaactaaaaaagtcaggggttgcaatcctagtctctgataaaacagactttaaaccaggccgggcgcggtggctcacgcctgtaatcccagcactttgggaggccgaggcgggtggatcatgaggtcaggagatcgagaccatcctggctaacaaggtgaaaccccgtctctactaaaaagacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccagcctgggcgacagagcaagactccgtctcaaaaaataaaaaaaataaaaaataaaaaaaataaaccaacaaagatcaaaagagacaaagaaggccattacagaatggtaaatggatcaattcaacaagaagagctaactatcctacatatatatgcacccaatacaggagcacccagattaataaagcaagtccttagagacctacaaagagacttagactcccacacaataataatgggagactttaacaccccactgtcaacattagacagatcaacgagacagaaagttaacaaggatatccaggaattgaactcagctctgcaccaagcagacctaatagacatctacagaactctccactccaaatcaacagaatatacatcctcttcagcaccacaccacacctattccaaaattgaccacatagttggaagtaaagtactcctcagcaaatgtaaaagaatagaaattataacaaactgtctctcagaccacagtgcaatcaaactagaactcaggattaagaaactcactcaaaaccgctcaactacatggaaactgagcaacctgctcctgaatgactgctgggtacataacgaaatgaaggcagaaataaaaatgttctttgaaaccaatgagaacaaagacacaacataccagaatctctgggacacattcaaagcagtgtgtaaagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagtagaaccggaagacatagagacacaaaaaacccttcaaaaaaatcaatgaatccaggagctggtgtcttgaaaagatcaacaaaattgatagatcactagcaagactaataaagaagaaaagagagaagaatcaaatagacgcaataaattttcaattgttacacagttgaatattagttacatttagtagctaaaggcttagattggagtgtcttttttcttcagagacagttttgttaaaatggtaccagttagaccaggtgcaggggctcatgcctgtacccagcagtttgggaggctgaggcgggtggatcacaaggtcaggagttcaagaccagcctgtccaagatggtgaaaccccatttctactaaaaatacaaaaaaaaatattagccggacatggtggtaggagcctgtaatcccagctactcgagaggctgaggcagagaattgattgaacccaggatttggagattgtagtgagccaagatcacgccattgcaccccagcctgggtgacagagcgagactctgtctcagaaaaaaaaaaaaaaaaaaggtagcaattataaatgtgttattggcttgcagtcattttttctatggagatatacatatgtgtattcatgtgtttgcatatataatgtattgagatcttactacaaacacatatcatattttacacatttaacattatatcatgaatgtttcttgtattacacacaaaaaactcataacaagtatttaatattcaataggtacttaatatactatagtatagatgtgccaacatgtatttatcaattccttattgttggatatttaggttttttattcttactatttgaaagaatatttattgttaacacatacttctacatttttccttaatatgtataacaacaaaggaattgctaaattaaaggttgagtatatttttgaagacacttgatatgcatggcaaaatgctttcaaaaaaattacatcatttcacatggcttctaatagtatacaaatgtgttcatctgtctgtagttatatgcatttgatagataaaaatggtaggttgctctaatttgcatttcttttattcctattgagaccaaacattttccatatgttcttttcctatttgtttgtctttctttttttgtctgctcacacactttgcccagaatattttagaggttttaaaatttgttttggtatttatggaagctaaaataatatagatagtaattcttagtcattacaattttaaatattttatctgatttatctttttggtctttttatgaggtttatgatgtagtacttcagatttttgataattaaatctttgctaatttatttttataaaaaatattttctccgtctacagttgaaacatatgttgctttattttgctaaatttatcagacttaaatttgtatacatgatgctgcctgtttctgagctatttatttcttctccttttacctgtttctaatctgattgaattgtggtgctttcaacatcttaattatttagaaaatacatttgtatcttatgggtaaagtcattattttctcccttcaggttattattcatttctgttaaaaggtcttagttcttttcatatgcatattcttccagttgaacattagattgagttgaaaaaatgacagcaatatttttaatggagtctccttcttatacattaattcttctgaaacttacatcttaaaatatttctcatctagaaatgtgttatttttccatttacttaagcagcttgtatctccattaaagttttgttattttccccataaggacctcacattttttgttagggttattccaggtatttttacttttgtgatggtgttcatttatttttattataatatttaaaaaatctctggtattacgtcagtgtttttaaaacatgccatttttattcaatactttaaaaatatttataaatctctgagttggcaatttctccagctctaggaagacagaaaatacacagatctgtacactcaaagaacgtgagtccagcccactcagtcatatgaacttagctggatataacacgttaacagacaggatagacatttttaccttgaacagaaagagctgtaattcaagttctgtgtcacagatacaatccgtacattatggtttctttaaataagccataaccaattttttttagtaattatttgcttccagttattcatgtgagattattaaaataagcttatgaagtaaatataagatgtttcaaatattcctatccattgagaaccccagaaattatccttattgaaatttttagaaaaaaattagataggtgcacaggaaaatccttataaaattatgtccctgacagagtttatatgtataataaaaatcaagagggtgggtgtttctaaatattcaactatatggattgaaggcattgtggtaaatccattacaaagattatactgtatatttgttgatgagaaaatatatattcttacagctataaaacaatgagcatcataaaattctatgattgcaatatatgacagtagatcatatatgtatagatgtatgtccatatatacgtgtgtgtgtgtgtgtgtgtgtatatatatatatatatatctgaacaaatatgaaggacacacaccaaaatataccaaaatattaataacaatgattatcttcacattttaggtaatttcagcttttctctttatggttgctgatatagccttaacatttataataaaaaaaaattcttttgtagttagacaaagaagaaatatgtgaagccaaaataggaaaacatgggggaaggaaggactttatatcatgtttcatctcatagcaaaactattggaagcatttcagaaacaaaagaccttaaaacttcaaactctaataagaaattgggaacaaaaatcttgagattgttatacaagagatgttaaagaccttaggcctcagtttctttcagaagcccagcaattgcaattattatttattatcactttacttttgcttgaatctctttagctaaaggtggtttacttccacttttccctaataatttatgtcttcatgataatagattttcttattatctttctgatttgtacctgtttcctatttaatgatttactctgtatggcatacatgccaaagttatcatgctagaaaaattattatgctataataattatgataccatcaaactgaattaaattatgtttcattgtaaatagtaaaatgtattaatttttttaaaagcttttttatgccagcggagataaataaagttacctttatgtactttcattaaacacaatgacagtacaagccaaactgataacaaatcaacgcactccttcttgtaacactcctaagttgttctgaaatcagctttcttaggactatgaattcaatgcaatgtattaaacagaatctgtgccttctgtgaataaaagtttcacctccatctcttgtgagtatatgtaggcagatctttgaacaatgaggttttcttccattgatttaaaatgaaaatgaacctggattttaaatgtgcattctaattgtccctttagcacatcagaacagcactgcctaatagaaatataatgtgagctacatatataattttgaattttctaaaatgcacattttaaaaaagtaaaatgaaacagttaaaactaatttagtagggcttggtgcggtggcttacacctgtgatcccagcattttgggaggctgagggtggcagaccacctgaagtcaggagtttgagaccagtctgggtgacatggcgaaaccctgtctctactaaaaatacaaaaattagccaggagtggtggtgcatgcctgtagtctctcagctactcaggaggctggggtgggagaatcacttgaacgtgagaggcggagtttgcagtgagccaagatcacaccactgcactccagtctgggcgacagagtgacttagtctcagttaaaaaaaaaaaaaaagtaatataccttatttaatacaatctatctaaaatatcattattttaacatgtaattaaaacctaaaagttaatgagataatacattattttttctaccaaatctatgtctgtattttacacttataggatatttcaatttagattttttatcagatatattcagtctgcatttagatgtcataagttttcagttgagaaagtagatccacataccaaattgtttcaaatgtatttaaaagttttccagtaactgaatcaatgatcaatttttaatttaaattcattaaaatcaaattagaaattcagctcctcagccatactacccacatttcaagtgctcaatagccatatgtggataggggctattgtattggacagcaaaggtttagaacacatgtataagatgttaacacagaggaaaagttaaaagttaaatcaatgccaaactattgggaatgttttgtctaccgggtttcaagaaataatgacatgactgatatttttcttattgaatcagctgctcggctggttggctcaactaatagagtcaaacagttgctgggttttataaacaaatcatctccttttttatttggtcctccaattttcttaaggcaaatatttgtgccaaattatgccaaagtctgtctctcctgaatatccctgttatcctcgaatattgttgagtgtcccatgaatataactgttaaatgctgttttgagttaaaaccaagaacacctatattgagaaaaaaattaaatgtagttaatgttgtaccaccatgttttgttctagcttctcaactgtctcatgtaaataagcacaataaacatctactgagtgattctgtaatagtttggatctataggtccatcatttgtgatgacacatagaagttggcccaggaaagctaaaagtatgtcatatgtcaaataatgccttccaccaagtttagagcagcatttcttccccagcattacaacttcatgtaatggcacttggcagtattggcatttctgatatgacttcttttggctagttcagaattcttaaaaaataaatagtttttcaccctgtgattgaaagggttaaatagtaccaattcattacactcacaaaaggatttattttgttctcataaatcagttttattccacatttttattattcccttgggtgagctactccaattgaaatcaatacaagtgcaagtgagacaatcaatctcgatatttgattatggattggagattcccaggtccgctttttagccagtttctttctgatcatctcccccaaagaactgaatatttttattgacatctatgagttctgaacatgtttagaaagaagataataatcttcatttgtatactgacaatggaagccccacaaatgaacaaggattaaaaaataaagacttaaaatatgtagctataacatcatcagcaaacttcaaatttctcaatatttttcttaagatgtagtcatgttttaaaataactttattctttcttttaaaaaaagacctgttaatacaactggtggctacaaaccacattcttagggtgctattaggtaaatgattatttttcatgacaaagatattatttattttcacatgcttgtttcagagctgaaccatatcaactggtctaggttaacaataagaaaacagttaaggtgaataaaatgcctttgaaggtatccagcctaggtcttttcatttctataattgtccaggctggaaagccaccatctgggggatttaaaagagaaaaacagctcaactttaaattagagagcaaaattgattaagttgttcctcaatgaggccaacatttatatatcaaactctctttgctttacaaacaaatttatatcttatgatcctttacatatcgaatgcttattttgggactcatggtaccatattattgttctcttgcctctgactctagccacctgttctaggttcttaagcaaaatttttgaaaaggcacaattaaacctttccgtaattcattatttgatacttagaataaggcaattatttgatgcacttatctaatcatattcttaaaataaatttcaaggtaatattaacactgcatttgttactttcagcaaacattttagccttatttagccatttactaattttcactagaatccattggaaggggatgtttcatgttttggacaaattacctaccactgattttttttcaggaagacatataactttgaatgttgtaaaaaagtattttagaaggagttaaaatagtaaacccatatttctttcatttaagcaacattaattactcttcagttactcttattaagcctttagaatagcagctgtataagccatataagccaggcacttggatttccactggcaaacttcctaggcatgtggaattaggggactgtctagaacttatttttgtccagcttcatttccttttcagtaatttgcatttattaatgctgaataatgaaagataatcaaaacattaatgaaggtatggtgcagtgatgtaacaaagggctatatcaacaaaatattctttccacgtgctttgttccactctttaaaaaaaatatttactcaagagaatcattctagaaactggaaattgctccctttattcaggaaggcagtatattttttaaaagttagcttctttaattgtttaattcagaggttggcaaatcttttctataaagggatagaaagtaaacactttagactttgcaggcaatatagtctctgccataattactcaattctgcagttatatcatgaaaattcctagaaagataattacttttgttctaataagcctttatttacaaaaataggcagctggccaaatttggcttgtagattgtagtttgtgggaccctgttttattataactcgtttatacattaaaatgcaatttacatactttccttggatatttcaatcttctcatgattcatttgattttgcaaaaattatgaatgctaatttaaaaatctatgtaatacagaaaaacaacatccactaaaatcccactacccataaataaccaatgttaacaaacagtaaacattattttagagctgtctcaattcatgggtgattcttggtagcaaacaacagaaacaaatttggttaattcaggcagagatgaattatattaaaggaattcaacagttcaaaaagttgtcaggaaagctggagagtcagacttgtggagaaccacaaataacatagcccagaccagcttatgccttcttaggacacccccactggcaccatcaccattcagtcgccttggaaaattatcactctacttctggattctcaacaattttagaggcatcttgaataatccttagttgactgtgagccattgtttcactggatcaagctttgtagtccccagatgaaagcaatgcaactgactggcagtcccatggtcttaccacatgaacttcaggtgtcctttcatttacaaaaaaagagaaaattaagttatgtttctaatcatttctttctacatacctattatcttctccctgattgttagagtttcttgatctttttacttatgcattaattatgattctctcaaggcttttcatcataccattgatttagattttagctctattctgttcctggctttttctaacttgtttattaaatacttactgcattttttaatttccagattgtttctctgtctctgcaatatcattttatcatattatagggaatatatatcattttttcccaaactacatggttattttgtctttttatgttacaatcctttctttagctgtatgtataatactcgatatattatttttttcttcaacttcatcttgcttatgccttgtatgggcagctctgtccagattttgcactggttctgagcttggtctacttcctttcctttctggtgctagtcagtcttctttcgacctaaattttgagcactaggtgttgctagagggtgcgaagatgcactgggcagaattctggggaatccagattttctgtctcctctgagatcctattatatagcttttgtggcagcacttgctgcatttattcacatgtatctcccacacctgggaacaccagctttttcccccaactcagcacagtgcttggcaggatggccagccctgatttctcttcctgtctctgcagactctactcagttcatttctctacatattggagaggattttttttggcttatactccttcctctgggaacaaagttaggagctgcgctatactaagaaggaatttaccatctctttcttcttttaggtttcaaaattcatgtcggtcatttttttccttttcctttatacatttgtacctggagaatcttcaactaaaattgttaatgttactgttttcatagtttgtttccattctgtcaggtattttggaaagacagttgtgtggtaccacttaatttagaagctgtgaaagttcacaatttgtccaaaatctctttctagcaaggtgattcatatatacagttcagagactaacagggagactgtaaggtggcatctgactttccccacctcctggtgttcatgtccttgtttactctccttcccttgggtgtcttcaaaacctgtgacttgctgctcaccagtagaacagaacaaaggtgatagcatgccacctccataagattgtaacctgtcttgctagaagactccctctttttgatacagcaagtggtcacactggggaggcccatatgggaagaaatgagggtgaacgccaggcaacacaaaactggtaactgagagcagccttgagtcaatagccagaaaaaattgagaccctcagtctcgacagcctacaacaaattgaaaactatcaacaaccacctgagcttgcgagagatccttcctcattggaaccttcagatgggatttcagtcctggccaacaccttgactgcagtcttttgagaccctgagcacaggacccagttagctgtgccagactcctgactcacagaaactatgagattctaaatgtatgttgctaagttcgtggtgataccatgacacatcgataggtaactaacacaggaacaccttactgtgtgactgtagcaaatgaaacaggtagaattcaacagcaaaacatgatatcattctcatccagacccccaagtcgttgctcttcttttacagaggaaccatctcaagtatatatcttccagtaattagaagaaaatgttaaacatgtcattaaacaaagaatggaccataggctttgtctgggatcaataatggttgtcaaattacttgtctgatcctagtagcaccacaggctcagcaggttcagcatggttagtaaggctctaccagaactttaaaaggaaacacgttttggtgataaaatagttgtattcatgtccagtgtttagtgtggaagccggagaccactttctatgagagtatatttgttcaataacttttagctgattgagataacagcatcagtttgttcagctggaaaaaagtttgcccaaatggcaaaaaaaataagtcaaagtggaaaaaaaccctgacatttcagagcatatatggttagtaaaaatagaccatacttctacaatttacaatagtcacagtacatctctgaatttactctctctctctttctgtgtgtttatatacatatatatagtgaactgtactgaattttatatatcgtagtgaactttatatataaaatgtataatatacatgcatatatacatatatctttcatttttataactatttttagagcagttttaggattacagcaatattaagcataaggtacagagatttttgtctatcctttatgcattatagttcctttctgatattcataaaatgagatacatttaggaaaatctgactgtggtacatagagagagcttgatggggaaaaataaaacatgcttcaacaaactttaaaaaataatttgcgatatttagaacagtaattgtgcctacacgttaaaaaagatctagagaacaaaacataaagattctcgatatctatagagttgtcattgctcttgtatgggcacaaccaggacaaatgtgtctgaagcatcttttggtgagttgataaaatagtgcatgtatttattccctgcactacaattgtcaggctagaggaatgaccaatttaaagaggagtcaaagaagtacagctttgactagatgacaactaattaaaatcactattacagtaattacagtaatgtaagaaatatgatgcattaatcgagcaccgtcctcagaaggtcttagtggttcataggctatttatttctctttcaaaatatcctgtggagaagacagcttcgtaggcatatgtccataaatattttatacattgtcaaaaacttaaggccaggaatagatttctttcaccatatattaattacaaaataaacaaatactcagcacctttcagattcctaccaacatgagatctatcagaaaaatggaatctggaagaaacacttgctttttggttaaaataatttaaaataatatttttagaaggaataaataaatgtaacttaaatattaatacagggtatatagagagacctgaaattcttggctcacagtaaaggctgattttgccagtttaccttgatcacaattcagtgtcttctgattttggtattggcagaatttcgtgatagtgagatggaactgaacaactctaaaattgagaccttaataccagaaaaatatagtatttctttgtacagcaagaagtgggaaaaattagttaataccttttctaccttaaggtgtaattggattcagaaaaagactaacttaaagcaggaccaggcctgacatataaaatcctcacgaggtaacaagaatcagtttggtttgttcactgtcatttctcattataatctttgtcatgagaatggattcatgttgtgccattttctgttcctgttacaatctttgtcacatgaataagatatcaggatgttaatgcctggcatacagtattgtgtgtgttatgatactgtacaggactacgctgacctttgcaatattatgtattctgattggttgttcatgtcacctctttcccacaagttaataaggctgtaaaaaggagagaactgaaatggccagccagtcaaattatagaatattgaaaaggtcagagcagtccagcacagagaaaaaaaaattatggaatatatggtgcattaaaattcttgtgacaatgattgtaacaagaataggaaaggatacccatttatgttattccaatctagagaaccccataggatggtattctcgagacagcaatcatttacgcatccctgagtcatacatgtgaaaatatccatttatgctgttttttccttaaaaataattgcatagattttctactattcaacaaaaaagagcattgaaaataagattttcatctcagaaaaggggcattaatattgttaacatttcagttaagactttatatttgagactaaagaaaaggtttttttataagtaaaacctgttgttcatatgagatttatttggtctattttttcatgtaacacttttctttgaaataaaataggagagtaggactgaatgaattaacctttttcaagaccctttagaatgtgggatagaccgaaagagcagttaggagtttatgtagaaattctacatgatctatgcaaaacttattttatctttatgatgtgtgatgttggccaatacacaaaaaatcttttcttcctctgcatcttcagtggaaagatagtgacagagagaaagaggtataatacttaaatcagaaaccctgatgttattgttcttaagtgtgcaataattacttatttttcaaattgtttttatgcatattttaaattttcttgtagaacaacttcattggattttgtagcctataaggagacatctgttttaaaccttagctttacacttatttcactaatagagtaaacatgttatagtccaaagctagtcaaagctagtgatcccagcaccctatgctctgatgctcatccagtaggcctggcgtagaattcagatatatgaatgtttatgaggtaaccccaagtgattttgatgtaggttgtgcctggaatattggtattggcaacctcattttgcaaagagctaagtgagacccccagttaaagcccaatggctcagaccaagccacagagggtggaggagggcaactcaacttcaaatcacagtgcttgggtgggggcgaagcaggcagtggggagttgcggttccagaactcagaagcttaaaaggtcttgcaccatccacttatactcacaaatagggtcagattggagggccaaccagacaggaatggtcgcctgcgataggacacacttatcactttcacattttcaagcttgatttttgaggctgaaccaacgaggctgcattttccagcccactgaaagcccagtttatgcagtgaaaagtggcaaagcacaaccatctcaacaagaggaacctgagcacaagcattttaaaaatctacccctccccgcccatattgaggagcccaaattcctaaagttcaaaggaagaaaggaaagacagtgagagtgaaatggaggaagagctaaaatctgtggatcctgctttggttttgaatctggaaatttttgagcttcattgagggctgaaatcctgtcagttactctaggtctgtgaattgaactgtatgtttgtaggggtgagagaacattagactcactcagctgtatagttactggagatgtacaagttcttttttgagctgagcaaaatggttatgtaattgcatacttctcataattattgagtaattatatacttcttataattactgagtaatcattgttctataactagaacttaatgttacaactaattatataattaccatgtattaatgttgttatctaggaagcttagaatgaagtgctacttatatatctccccctgccatgccattttcaaagcaagcagtagtgtttgttttttgtttgttttacagttcaaaatttccttaaaaaacaaacaaacaagcaaaatgcaatggaaaaaacttcaccaatattatactcatacatatttactcattgattttgtatttgtccctggctgaaaatttgtaaaattatattctcatggcttaattttagaatttccattgttgctttacaaatttcaatcttttataagacctgcacagttacgctacttgagagtcaattgaatatctgcttgagtctataggacaagctgacctttttgaaagtttacaattgagcatgtaatgacagcagaaatacttccaaggagctcaatatcatggggacaggaggagatctccccatgctgaccatgtaattgttcttaggcaatggttaggatggtcatatttaatcttaaccaggtttcttgagtgcaagaattatgtcttatgtacttggggcatgttctcgtcagtgcctagaaaagccttctccttgcatgcagttggagctcaataatcttcagtagaagcaagctgactagttgtaaagaacctaggaaagctaaaatggcataaattggaaatgtctttttagtgcataatgaaattatcaaaggctgctttgtaggtttcataatgtcttgctaataagtattacacatatagaggagtgcattatctacttacattttaggaccttgaaatcattctttaagctatgaatatgtctttatctgcctttactgaaagtgaatagaaattatcattgtcacgttttagcccacaagcactgtttatttcctttgaagtaaactacttatttggatgtgccaattttgggtccagagtaataaattatattatgccattagggctttcttctgctcatgaaaaaaactcctgagtattttgtaacagtagatttttcagtgacttcctccatccctaaatggttataagtatctttttaaataactttttgtatgtttttacaatttgttggacctacccatatttcatgaaaatagtcaagtaataaccagatatcagaccctcttttgcattatttgatcttcattaatttcagtttgaaatataatctgatgggacaatgacacattggtaatggatgagattagtgctgctttattcattgaaaaaccttagaattttgatgaataatacattgttaggttggaaggggtagagaataggtaggtaattgctactgagaaaatgaaatacagagtacaaaattcttaatcacttgctagttctgaatggctagaatgtatcagttgtatggattacaacaaaaacaataacatcattcctagctgttgtttatgagcaactattatgtgctggatatgataaagaaataatctcacttaattttcacaatagcactgcaatgtaaatactgtattatcattcccagttcacagatgaagaaccagacattcagaaatattaagtaaattagcaaagagcacattgctaaagaatacaagaacaagttcaaatgcaggacttttgacaaccaaatttatgttctttcctttgcactatactttgctactaaactgtgttaaaatataatgtttttgtaaatattgtaaaccttgcattttgtatactatacgatgcaagatcacttttagtatgatgccatcttttactttttaagcatttgttcaataaagattatatcagtatctggagatcttgccagtatgcttgttcttctctttgaagctcaatatcatgtgttttttaattcatttgtctatatctgcagaatttgtgtgtgaaagattgaatgtacatataataaaaagtggttttatataggaaaaaggttatttgaagtaaatattggtgctcttttagataaaaaaatctcactctgtgacccaagctggagtgcagtgacacaattatagttcactgtaatctcaaatttgtgggttcaagtgattctcccacctcagcctcctgagtagctagaactacaggctcataccaccatgaccagataatttttaattttaattttttgtttttagagatgaggacttgctatgttgcctagcctgggtggtactcttaatcattcatttttctgttttttaagagttattgtatcatttctaaaagtgacaaacattaagcagcatttaaaaaattgtctcataaatttttcaggaaagcatctaatatagaaaatgttacaattttcatctgtagcccttttcttattttaaccctaattttttactcttaacctgaaatttaacctaatggtgtaagagagagagataaaacactgttactaggcagaagtattttcctgcattttggactgatgagatttaagaatgggtttgctaaagctttggaaggacagtggtgttgggaccagggtgaggatgtattaaaagtgattcttttatatagctaggcagcttctgcattttctcataaagctaaaaatattagatcttctgatcaaagtggacatatagtacctcccatccccagttgcttttcaagatattctgactaattgaaatttaaaagggcattagatagaaagaaatccacccacatttcaagcaaagtgaacagaaaacacctcagtttgtgaaatatacaatatctgacaaatatgtctgagtataatacgtatatccagaacaattctatttgaggaataatgtgttatttcttcctgtctgcacatccaaaaaaattcagggatttttattggaaaaaaaaccctcaaaaaagtataaacaactcatcaagtaatcaatttctacatttgtgcaatacttttacttatatgcttgatacttgtgatatggctttatcctacagttatctaagaatattcatcaaattatttcgattgccgtgatgaatgaattggccaggtcaactcagatagcacttttgttcacaagataataaaatccaaatatgtgcattgatagaagcacatgtaatgcctcttagagtggtaaagttacagacctatttggtacagtatatttagaaactcaagaaaatactcaaataatagcaggaatgaattcttaaatatgtatttattttaataattttcttttttaatcagtaggtaataactacacccttctgaatgtcacaaaagtcatgtacagcggagaagagacaaacctttgggtgctcatcgatgggctggttccttttaccaactatactgtacaagtgaatatttcaaatagccaaggcagcttgataactgatcctataacaattgcaatgcctccaggaggtaagtctatgcaaatgttggctatctaattttatataaatgccctagaattaagtttccattgaataccttgtttatttttagaggtattttattttagaacttagaggctcaattgtatttctggttcttttaatagttgttgttttgctttgtttattcagattctttaattgacgatcttttattgttttgttgagactgctttcatccacctcacactgtgtgtatgtgtgtgtatataccatacacacatacacacacacacatatatatatctggatttctgcatgttaagaaaattgggaaatgattttgttcaaggcgttacttaaagccaaaatttatatttgcaatttgagcttccattttctactgcaaatggttctcattcctggtgttctaaataactagttcaattgtatacttaaagtacttcatttggcaaaaagggcagggtgcagatgatagaataggaaaattccatttgcactactggaaaacacctttaaattcctgatcctaataattacagttcagcagggccacattcatgtgtgaaatgtgatacagtctgcatatttttattttaaatatttctataaaaatcgacctattcacaattaccattattttgatgtgccttcagcttcaccatgttttaactcgttgcgggaaataatcgcattgaggaaaacccctctagggttgacatggatggcccttgaacagaaagcatgcctcaaaatgttaagagcatgactctcaattgagtgctaaagaatgtgtgttttctgaaaatcctgaaggcaaaggaccccaggacatccagcatctgccctgtagcccatctcccaggaatgagtatattctgaactaagggagaatgtcacaatcttttatcagcaatccgaagggcaggttaaccccacttccagttatgaagagtataagaacacaaagtgctttatcactggagaaaaataaaagggaatcttcagtttgtatggaaccgctcccctgcaaaaaagattcattacttgttgtatcataaaaccacacactattatctaccttttatgccattattaaaattaatgaattgatgtttactaaaatacttgaaactgtaaatgtcagaagctacattacttaagaaaagaatgcataaaagaaacttttgaggctgatcaactcaggttagtatcatatttattgagacaataattttaaaagggaattgaatttagatatatttatttaaaaattgagactgaaacccaaaataaaacaaactccccccgctaaaataaaccttaggtattcatatcttcatttttcacttcaatacacatgctaggaaggatagaaaactgtgatggctctaaaccttagaatataatatcctttactcaaatttagaaattaaagagtaatcagtgccataatggaggttttaagttatatagtaataccttttctacaggatatatacaatatttaataagcgtgtttattttagggtatttatactgattaaatagtttgtgatttacagtaatttatatcatattcataaaatagggcaaatttaattcattgtttatgtttttaggaatgtatggtctaataatttgttatttatacatatatcaagattcaattaaaaatagcaaggtcctactgctaacggaatatgcgctatgtgaatatacctgtcagtaaaagggttaatattatacaaatagaaagaaactaaaatattgttttatagtggtgcagtcaaactgagtaaaccattaactgaggcttatcttcatctttgctctgtggatgcttatctgtgtcattaccataatgcactgcaggcccacactctctgggcctgatgcaatcctccactttatgtattcagaaatctagaatttgggagtcagtccttcaccaaagaggaagcaaatgtcttcaaagacagacagtgattcgctaaagtttattatggccattaggacatactttcttttttcattagattgttgttgattacaattaggaaacgtatagctttaaaattatcttttttatgaccttgtggcagtttaaaggtgatacctcattgattaaataggttttagttcatgcttccttttacttaatgatctgaaaacatattatcctgatttacacataaaaatcatgctgaaaagcatgtggcattcactagaatatgtgtgtttaagtagaattaaattagtactgagagttattaaagaaatcttccatgcctttgtccagtgaactgtgtttcattctgaaatgaataataaatggaccaatatacggaggcaaaccaacttatgggcagagaaggttctatatgctatttacttttccattatagttggattgttatcattattgccatttccttgatttcaatattagatctctcttatggtgatgttgaattcctagtatctttcaatgctgggtgatgcaagatttgtgatgataatatccttagctatgcttcttttgcatacttttaaaacataataagaaaagagttgggcaaaataaaatgctcttttttacttcatcaaatatttgctatcaaatatgacctggaaaatcccctttacccgtttaatctggccaaatcctactcattttttagcctcaaacctagaaattggtctatcagaaagtcatgttttgccaacagaggctgagatagggcctttctgtatcccagagaacagttacattatactgaaattgcctgtttaatctgtcacaatcactggttataagatcctatagagtaggaactgtttcttactcacatttctatcttcagcacctagactaaacctgacacatggtaggtgcataatgaataattggtgaatgaataaattagtcaagattgcttaacgacttgttttaaattttaagcttattattactcaggccctccaggcctcatctcaacctcagcaaccttgtattttagccagctgtgaaagagaccttctctgtacaccactgtccaatgtaggaatgctctggttatgtagataaaattgggagctcaaactgtaaggagggtgagtgtattggaggtgagaaatattctcaagttatgccaactcttcattcttttattcttccctatagtggttacttttctcaggtgagcatagaataaacaatccttagtttagatagtaatttggaaaggagaggtgaaagggtcatactccaaagaattttaccaggatacatcatctcttaatttgtagtcaggacacatcttatttgccagtcctacctctatttttctgatgagaaaaaatatataattaagaatatgataaacacaagttatttgaagatagaaattaaagtaagaagatggtgctactaataacttggcacatagatgaacagtggcaaatcccaattaacacacattttttatttgaaaaattcactttaaatattatttggacaactggaggggcgtctctgttttttccaattatgtagcagatccttccctacttctgcacactcaagttttttgtatttctacaattactatatttttaggttgtttgtaataacataatgctcatatttagcactaaggtattcttggaaataaaggatatatttaatcagagctcttgaatagtattatggtacaggttcaagagttctaggaaaagaattaaaaaaataaaaacgaatccaaatgttaatccataaatatgaaactttcctatggcctttaccccttcaaggtctggagttactaatggggttaggatttcaacgcttaatggggctcagtgcattagtgttttgtatgcatggaattcagcattcagtttaataagtggttgacattggtgatgtcccttaatttgcttaaatctaattggctcttttatcagtcaaacctgtatggattggcaattgatcagaaagggtcagccatgactctgcatgtagttaaatgatggaagcaccagttaaagtcacagttgcatgataataagcaaaagaagaacaaatgagcttagaggaggaaggcaaagaagcttagaagttttgcaggatcttcaagttcagaacaaaggcattatagagtatataaattttaaatacactgcattttgcctccagacttaaacctttttttttccagatgaactgaaatcttgtctgaaactgtctttgttacatcaaagaactactcagaaagctaaaagagacagaagaagcataaaagggcatagtttaaaatgattagtgacaaattccatactgacgagctagaaacagatttttaatgaaagttttatattattccaaaaggaataattctgtttatctttttctgaactgctttattgtaacagtgaaaggaacttggagccaccctggtttgtgaacctaatccaattttcctctgagagtaaataatttgtcatttgtacttttaagttgatgagaattattataatctacaaacagtgtaaaatactaggcttgagaaaatctgtttatttgcccaaatgtgttattagagaaccaaaaattgaaaaaggcaaaatggttgcgagtagtttgttttacagggtcttttcgactctctctccttcccctgaaccccctctccacttatccacctaaaatatcaatgagaaaaaaaagaaagaaagaaaaccattaggaagtaaaacttaggcacatcgcaaaagcatagacgttggagtcctagaaacaaggatttaaatccacctctttcactcactgcttgagtgactatgagcaaatctgcagatataactgagcttcagtttgctcatccattaaagaggctggatggtaattcccacctgactggaggattgaacaacatattatatgtaatgtgtttagcgcattgcctgtcttggtaaacatttggtgcttcctacctcttttgttctattttcctactaagactctttttggggacctggaaaatgccctatagaaaaagtaagtaaaaaaacctgtctttcacatagactgcagagaccagaataatttcatcttgctacatccctatcctttcctacacttaccccttaacatgttgacatacatatggccaggccagtaaccctgctaaggggtggttgtgatgcatattagatgatgaagtaagcaggaagcatgggaagtgattttctttttgaaataccttcagcatcctcctccatgacctccagatcataatttgcgaagatttttacatcaagctctcattggtcatcttgggatttcacatattttcttaatagaactcttcttctgtgtttatatagagctacttattaaatataattatgactttttaaaaaatgtctattattgtatattttattcacaaatgcttttttttacattgttaatgctagcccaaagcaagtaatttgaaattttatcctaagatgttttcatgttttcttaattgtcctcaaatacatatatttaaaagttacatcttggaattcaaactttttttcatttttcactaaataggaaagtttactagttgttcagccaatatgcttttgaataactaaataaaatgtttgcttttaaaagatgttagtatatgatttttgcccaataataccactaaaggaataatatattaatgactaacttttttagcttgaactactgaattccattctgtttagaatttaagagactggaatattctttcgggtattgctgtgtaacgagtcactccaaaagtcagcaacttaaaacaaccattctgtattatttctcacctgattgtgtgagttgtcagcatggttctcctggcttaaggaggctggactgggcttcttcagaattcccagaaagaaactcagggtttcaagagtcaagccctagtgtacaagccctgaaaacctttgcttgcctcaaactgtccaaagcaaatttcttgcccaagtcaaaaagcatgtatgctggaatgtatgatttactggagcctgataatttgtcaatcttccataaatgtctaagtgattggtttttagattgtgtatgtgtatatgtacaaacacatacatgcaagtattacagatacataatttttcttttaaattagttctgcttttgaaataatgatgtactagcaccaaaaaaaatgaagaaagcagtttactaaatttttccttgaagaagatataaaaaaaaatctttccttacatgacaattaattttgatgttttatttcagtataaagatcaataaatgtatatcaatagattcttgtttaaaatgtttgtagctccctattggagggaaaattctgatctcttcttataagtaggtgatttaaaaaaaaatcttagctatttctcaaatctaggccttgggtattctgatttctgcttgtaactttgaactgtgagagtagaaactgtgtgtaatttgaatattttctgtagctccagtgtctggcataaactatttgctgaataaattaccagagccctttgtggcagtgataacttggaaaataatcctgaaagttatattttgctattgctgtgtcttttacttggataaacattttccagaattaaattcaacatttagggtttaattcatcctaaaattatttttagtcctgttaagattaccataacagtgtaaaaatacataatataggaccctctggaggtatgtttataaatttgtgtgtgtgtttaattgtctattttacctaccattttattttttatttttaaataattccatcttttatattatgtttaggggtacatgtgcaggcttgtcacatggatatattgtatgatgctaaggtttcaggtatgattgatcctattgcccaggtagtgagcagagcacctaatagttttcagttctttgctttctcccactgttccccttctagtagtttccactgtaaccaccattttcaattaacttatctattgtgattggtggttgaacacttaactgaaaataatgattaaaacagaacatccaaaaatttaaatatatattaaacacaactttaatttagaacacataaatatatttatctatatatttatccaacaatcttgttatatagggccaagttgttttcttggagtgttaatttagtatttataagtccagcatatttgctgccaaaactatattcataatgcatagtttgatttccactttgaaaactcctttaaaaggagaacaaaaatttagagataattaaggaagaatctaattatagaatttttcaggcttttgtaatatcctaagtcttttagttatttttcctgaacgaatttcacagtattgttttattaagtcctcactgaaagtttttcaaagcagtaaattttcatagaaaacggtttctgttaacagtgctcatcagtttaagcattatttaattaaatgacataatcataatgacaaccacaattgacatcacaggtttaaaaaatacagctgactctttgtgagtgtataattctacctgcgactgcagaatgttgcccttgaactacagagtagtcaactatccatctctgcaatacagagtaaatgtaaattttttattaatctggcaagtcagataagaataggtaggtaaggctgggcgcggtggctcacgcctgtaatcccagcacttcggaaggccaaggagggtggatcacctgaggttgggagttcgagaccagcctgaccaacatagagaaaccccatcgctaccaaaaatacaaaaacttagccgggcatgttgtaattccagctattcgggaggctggggtaggagaatcgcttgaacccgaaaggcggaggttacagagagccaagattgtaccattgcactccagcctgggcaacaagagcaaaactctgtctcaaaaaaaaaaaaaaaaaaaagataggtaggtaaagcaagtgtctactatttaggaaaaagacacgcttccaaagtggcagaatgatccaccctcagagcagcctacccaagtaggagaggcaggacaatgctaccaaattcttctcttaggttaagcattaccacagctctgccttaaaagaaaaaagaaattattgattatatcccttcaattgattagggactgagtctgagatttgtggcataacttgctcagtgaacttatttttctccttcagtttttaaaggaaagaactgagctttctcttctattttcaaatttcaaccaaaatctctttctaagaccttagagcaatgaaatgtgtgggtagcactatcaaccagccaggtggagaatggtatttttttttttttttttttttttgcagggtctctaagagaattaggggcaactagaactggctcaaaaagcaagaatatacgaaagagcaaaagagtaaataaataagaattgcaaaaacaaactctattgtatcttgcactttcttcatgcattgtagcactgagaattgtaaaatatttctataccttttgtttgtttttgttcttgtttttttgagacggagtctcgctctgtcacccaggctggagtgcagtggcgcaatctcagctcactctatgccttttaaaatcaacttagtacaatgtcaagatgctactttttaaaaataaaactaatggttctcaaaaatgtgaaagcttgcttgccgagtacagatataaagctcctcaatatgtgttttccatttttcatctgctctgtatccacttagatttatttgaaatatataaatagaaacattaatgtgcaggtggcaatgggatatcttaaaaattgaaagagtacaaagggatggagattttaaaaataaacgtaggttagcagctgaaataagcaataggctaagatggtatattcccttattcagagggtagaaggaaagatgagattaactgctttttataatgtaaaagccacaatgaagatacaggatggtgaggaatagcattctttaaaacgacaacattctaccacataaacagatggtttgtctttaccttcagtatattaaaagctacacaatttatattacatccagttcatatgaatctttcgaatagttgtgcataatgttttacttctgtgtatatcttccaaatgtgctgctattttttccctggaaaaatcaacccattgaaagtaataaagtaggagaattcaacaaataaaaagtatttaaattcttaataaaataaatagtgtgctttcaaaaacacataccaggccatttaatttaacccatgctttctcccaggtacgagaatagaaccaaaggatttatgactgtcttaaacatgctctcaaatcctttcctgaaaagtgttacctttacttttttggaattgatagtttaacctgctttgtgtgtgtgtgtgcatgtatgaagaggtatatgtttgtaatattacatatcataagccaaagagagggataaattcctgtttcataatttgtgaacaattttttcactttttgtattcaccatcttgacaatgaacttcctgcttataaaaacaccttagaaaaagactaacttctgagctatggagaagagggaaggaaactttgaagtgtgcttactatggactcaacaagcctccagcaaagggctgccagctctccatatttgcatactctcatgtggattatatagaaatacacacgcccacacacacaattaagtgctatctttaaagcatcctggggcaagagagagagacttaaaaaaataaaataaaatcacatctttttcttttttaccaggggagaggggtgggaaatattgttcctttaagttccattgatattttctaactcacatttttaaaaagaataagtacaattcattttctttttttttcttcgaagacggctttatccataactttaagcttaaaaaaaaaaatcatgtctgtctgactgacactgcagtctaaaagcaacttgaagttttatttgaatttttatagtgccctaaagaaatttttgctttatttctttaaaataatatcttgttcctcattttttcatagacaaactgtatgcctgacttgcataaaattctatgaacatttacctgcctatataaatactcacaaaagtgagaaaattcttaatatgtcttagatacttagagaccatatttccaacctcttttcatcagcagcatcaagaaaatccctttttctatctctataaaggcatatagaccccccagagtctaaaagaaaacttaaaaacttaaggaagaatagattttgacaacagtagggaaattcacttacaaccactatgcttttcatgattgttaattaattgggacaaatgaaactagaaacatgagggtatctaatatatactttattagattaatccctcttacactttgatgaccattttcaaatgtatactatctttcatttttatttaaatgtttcgtatgcttgtatcatgtcttatctactagatggggaagataaaacgaatgggctgggtgtggtgtctcacacttgtaatcccagcactttgggaggctgaagtgggaggattgttgagctcaggagtttgagaccagtctgggcaacatagtgagaccccatctctatttaaattttaaaaagaagaagtaaaatgaaaaaaaaaatgagtgggtgaatggaggtagacagaggagtcacagctggtctccctttttctttctctatccctctcaccatttaccttggctcaggcatataataggatattagtaatgattactatcatgctcttgtgcagtcctagtggcctggggctatttttgcacccagcataccttcaccctttcttttgatgacagggctccaatttccctctcagcaccctgggctctttcaagatcagaacatgcacatgcgctgtgtgtgaagttgactgcatcaccaggtctgaccaatgaggacactgtattctcctaaccacagtgattttttttcaggaatgacaggcattccaatcaaagccactgaattgcagtaaaccagtacagtaaacagaggcatgtctcttgccctgtatttgaatatgggattcggctcaatttgctgccagccatgttgcccctcaaagagtctgagaaatttagtcagcaaggaagaaagcagagtgggtatgagagaaggaggtagactagattctggtgacgtcatttgatcctttgaatccagcattgccaaaacccagctctttcccttgagtgtttttttgtttgtttgtttgtttgttgattacaggaacccactacccatctcattgcttaagcctctatgtgttgtgttttctgccacttgaaaacaaaagcatttgccacaatgcttgagagaaaggaaaacaagtagagagcatttagagaagtctcatcacttcctgaaaatcatgccaaatgctaaacttaacatatgtgtttggcttttgcttgggctctcaaattaggaaacctcaagaagtaagctggatgtcacatgagataatattttctaaaactgtgaaatggctcatcccattctgaagggtctcctcagagccacttcatttgacaatcttctgagctgtttctccactattttcaggtctcagagccctgagttctagtaataactcttgtgctaattagctgtttggtctgacttaagtaactttacctgactatgatgttggtctcttatctctaaaatggcagatgtgaattagatcagcagtatctatagtgtgatcccagaccaggaacttcaacattccttgaaatttgcttgaaatgcaacttctcaaaccctactctcaacctacttaaccagaaattctgagggtggggccaagcaatctgtgttttaatgagattccattaccaactcccaggtcactgggtgccttcacaagtttgaagaccactgagctagaccatctttaaaatactttcaaagaaaaaatatatgatcttgtctatgactttattccatattcatatttgagacaaatactcagggaaaaataggtataataggcctccatgctcaactggtctttgaatatataagtcacattcgtagggccagaggtctttccaatgtaagaaagccatcgtgttgctcacagtcttcctgaatgggccaggaacagataccaaagataaccaattccagatgttgagttctacctgtggcaccagaaagcaacaggcatgatgttttatgcactggggaacactaatcagccctactgtgaagacactgtcagctaaatttcctttgctcttcaacttcttcacagaacatctgctataagaaactccttgtaactaaaacctgagtctttcccctctggggaattttctttaatgagcctcttgtggctacatctgtacagttttgaaatatgtttcctcaagtcagttacatcttcatcctggattctagggtttgctgtctattggacctcatagctaagatttttccttctaggagttcacaaacacaactccagagtaggttgacatagtgcccagtatctagagaaaaattaagatcatgtaaccttttatttgctaaaaagagatttttgatgttgtgatcactcataccaagatagcatttattaatactaggtgcaggtgtggttttgcatatattaactcattttattctcctcacaaaccctgtaaggcaagtgctattattatccctatttacacataaggaagttgaagaaacaatattggcttgcaactagtaaaggtcatcttactagtaaaaggcagacactgtatttaaacctagagactgactatagaagcctagttctgagccactatactctattgttctactgactgtagaactatactctatttcttctactgactgttcatatgctctcttggcagcagcaacacagattttgatgccccactaatcaatgcagatctgaagaggtgacttgactctatagtagggtcaaatataattttaagggtattgttggttgaactagtaggtttttaaatcctgttgcagatggcctagagaactgtcctcagtgactgtataacccatgctctaaagtttataatgtcataagagaaaaaaaatgtaggtaaaacatgtttacagccttacaaaaaagcattaagcagaagcaatattatgtggtacgtaccctgtgtggagaaggcaaagaaaccaaccagttggactcatcctttgccagtgtggatataagtacttaacttgcccaccaagtattttgcccaacttctgtcatatttacctatgaacttctattataaattattataaattgtgatcttctgattgtacatagtttgcattcttgtgaagagacttaatttatctaatagtgttaattttgaaaaattaacaaactttcttaaaagagagcaagaaaacttatatttgtaaaaactaatgaaagaaagaatctttttcttcctgtactaaaacaattttctgtgaacagttgaaaaaacactctagtcaggtgaagacacttattcatatgtggaatattctagaaataagccatgtgaacagtatgagtatgtgggaaaattgttcactggaatggccacaaaatgaccatgcgtgacctctgggccataagaaagcaggaatactttcctcatcaaaatctgaagttgagggcatgatcacaggaaaaagcttaaatcttattcccatggttgatgctataaatcaagtaagcgtgtatcttagactgtgcatttgtaaagcacagtgtctatcaaaatatcacaattcaacttatccaccacttgctatccccagcattttcatttcctgattgtgtgaccttgagaaacttttctcctctctaagcctcattttgctcatctgggaaggggtttcataattacagaactttcctcaatgggtttagacaaggaataaagaatgtgtgtgcactgagattagctggcacattaggtagctgctcaattctttgtttaaaggacataaagcatgatatataaatacaaaatatatgtaagcttatcactattcagttgaaaattaacctgtaaacatctacatttttatcttctttgatgattccaacagctgtctctaaaactaagtgtaaggaaacagcagactggttgtggcatattaaattataagtgaggactaatttgaggatcaaagatgctctttgggagatatcgcctgactagtaggaaaagcattagctgtctccctctgtctcatgtatttgttctctctgtcttggaaatatccttccccacagtttctgaatcttgatgtttaattgaacacaaaggtctttgagaaacacaacagggggttgttcctggtagttctagcattgaggaaattgaaatgtacattttttttctcatttatcaaagaagggcaagaatctaaactgacattttatatcaaatgaattatgaactgtgtactttgtacctaagggaacaacaactaaattagagttttagttaagagagagagagagacaaaaataggctttgaataaaacatacagtaatttctgctactgtgcctgacagtgacatggccagatacagttctattgtagaactagtgactggatgcaggctactctgaaatctttaaatgtatttgagagaccgtctcagaaaaaattaaacctaaatttcttatgttgttagactttatggtcagtgaaatagtcttgataatctaaagttaactttcagctttttatcaatgcttactttcttaaaaaaaataatagttgcaaagttttacttcttgagaaagtatgaaattataggttgcttgagagggaaaatacaatgcagaataaaaataatatatatgaaaatgccacattccatctctcctctgattatctgtaacacctacacaaatactacacactacactcatatgttattgtgctcataaagagtgtgaatcctaagatcagtgggacttggttcaaatcttaatttcccccctcctactagctgtaagagcttcggcaagttatacaatcagagtctgctttactttgttcttctgtaaatggtagtaaataataagcactatctcacaggattgacactgagaacttaattatgatgatgcctgcaatagatacaacgtgatgcagtacacatagtagttgttacgttgcacagttgtttccttccctatgtgagaagattaggcagcagcaaattagaactccattatttaatggctgctgattcctgaagtataggaagtattagaattaaaattttaaggagaaggaccctataatgtctgtgcaatatatctaataatcattttttaaataaccaattgaaaattcttgggaattgggggtgattcatgctttcttcttctggacaaagctatgtattgattaccatatttttcttcacaaataagtattccaatttatgcaatataaaaataaaagaagcgttattaatatgaatacatttgttttagacttctaaatccccctaggttcataaacctaaaagtgacaaaattccttgatattaatcccatatgctttctgatgccaatgctatactggataataattttgtgactaaattactagaaacaaataactatcactgatagcctgattacaaattttcttcatataattattgatcattgctgtggtaaaatgaatatcataatttttattctcaaatgttgattctaactctactacttataaggtgaaatcagttcttagaagtctttcagcagtttaaattctgccaatgactattgttttattcttactaatagataatgtgaaattaatggcatgttgaggtaagggatgctgtcttgtccgtttaggcggctacaacaaaatactatagactaggtgccttacaagcaacagaaaagtatttcacacagttctggaggctgggaagtccaggatcaaggtgctgacagattcagtgtctagtgaaggctcttcttcatagacagtcattttctttactctaacttcacatggcagaaggggtgagaagtctcccttgggtctctattacaagggcactaaccgcattcatgagggctacaatatcataacctgatcacctcccaaggctccatctcctaatattatctccttggcggtgagaatttcaacgtaagaattataggagggacatagaccatagcagacaccccacatttaagtattttaatgctagatctagttagtatttgagtaatttaattaataaacttgaatattatatccaatcccgttgttacaatgacttttataaccaatctgctctgattcttcaatcattaaatgactaaatttttctccactattcaaagatcacttaatttcttggtatttgattgtatcttagaatagtggattcaatggcaccatagaggaagagtccaactctaaaatataatggtttattttctacacgacctcagtcattttttgttttgtttttgagaaaggctctcactttgacaccctggctagagtgtagtggcacagtcacagctcactgcagcctcaatctcctgggctcaagcaattgtcccacctcagcatcctgagtagctggcaatacaggcatgcaccaccacatccagctaattttgtattttttttttttttttttttttttttgtagtgatagggtttcactatgttactcagactcgtctcaaactcccgggctcaagcaatctgcccatctcagcctcccaaaatactgggattataggtgtgagccactgtacccagcccctcagtaatttattttgctatttttcttgttggatacattcaacaagggataatttaatgcagtcttcctgaaaagagtggctttgacttgagcttgaatttatttattgttaaccttgctaagcatatcaatttttaatttcacaaagactaaattcttcagtgaattattttaaatgaagtcaatgagcaatattagaatcaaaaataaaatagaattaattgaacagtattgttgtatatattttaaattatttttccaattgaagatatgctttaaacaaagggctcaagcaatcaggtactcaaggaaaaagaatttaatctatgctgcctagaaactaattggatgaatatgatcgtattcaaaataataggaatgctaagaaatgctcttaggaatactaagacgaattcaaatgtcgaaagcaaaggcttaactagagtgtctaaatgtaggaagtctctgtaaggaaaaggaaaaaaatttggttggtggtttgagacataacaaaaaaaaattcttctgggcattatgaccaccaacttcagggcctctaattagtctgacaaagtgacagttctacattctagttgaacaaataatgtatctaatgaaattcaaaatcgctatttttctctgagcacagtgagctgcatcattcacagctttggggtatttcaaaattaacagaggatgacttcagtctgtctgatgtttcttggttaacaaattcactgaaattgtcttgcagagcaattttaagcaattctttaatcttaaaccacaaagagaggtggaggtggaggtgtattaccttggtcctatggatgctaatgtgaagtggaatcttttatttctcaaaatggtcaacagcaattagtattcagtggtgtctttttattctggtgcccttgacccacctctgcccccctttctatattactcctattatatactgtaactggggatattcttgcttcttttccattctaattaaagcattcttagtgaacatgggaaccatttttcatttcatgaagaataattactggacctaggtgaaatctgcccattgggttttatataatttttgacaaatatttgcacgaattttgactgatctattcttaccatttctccgtgaaatgttggagaagttttcagttccctcagaacaataaacctaaatatgtacgtgaaagaccaagataaatgttgtaccaccttcaggttgtatttgctaatgtactttaaaatattttattttgtcactaatataagaaataatgatgactttttaacaatttttttttttatttttgcacatgtttctttcctagtcagagtttgacctaaatactcttctactacactagtgacaaccttgagaaatatcatttatttaggttggatctgtaaaacctatagctcttgttatacatcttgtttcttttttttattttattattattatactttaagtttcagggtacatgtgcacaatgtgcaggtttgttacacatgtatacatgtgccatgctggtgtgctatacccattaactcgtcatttagcattaggtagatctcctaaagctatccctcccccctccccccaccccacaacagtccccagagtgtgatgttccccttcatgtgtccatgtgttctcattgttcagttcccacctatgagtgagaatatgcggtgtttggttttttgttgttgtgatagtttattgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatatgtgtgcatgtgtctttatagcagcatgatttatagtcctttgggtatatacccagtaatgggatggctgggtcaaatagtatttctagttctagatccctgaggaatcaccacactgacttccacaatgtttgaactcttgtttctttatttttctctagagtcctttctcagagccaagggtgtcttgacaagtaaaagagaaaaaagttactaaacagagagaaagagagagtaacagactaagaaagacagagacaatttcttcaaacctctactccaaaaaatcctcctcaaaatttaaacgacacatttgtttaaaacctcaaaattcttgcattctttcaaaacactgagctgttagattctaccaacagtatccgctctccaagttagttctttaggttcctgtgtgttggatggggaagaggtagggaaaggaggctagctaccttttatgtctgtgaggaagggcaaaggtctggtttggctaattttaaacaacattgtttaaaataacaggaacttgaactttggagacagttgctagattcaaacagcagcacaaacccctcattacttgtgtggtcttgtgcaagtcatttatgttatgaagcttcagattccttgacccacctacttcacacctaggactattaggaggattcagtgtgatgatacatacaaagcatttagtccattgcctggtgtacaataactgcccagcattaactctgacattgtagtgtgcttatgtttacaaatgaatatcaagatgttagcattgttcaaggggcaattaaccaaagtcattcattaaagttgttgagttgtttaataaacaactcaattaacataaagactctttaccaaaactttgaactttgttcaaatttcattcatccaaaagcagttgctgagctctttctagccaccaggcataactctaggtcctgtgcaaaacaggcttttggagcagatggcgtgcattccctgatggaactgaaggccctggccaccattgtggtgaagttcataactgcacttactgcatgttctggctggctacttaagaattccctaaggagatattggatagatcaaggtacttagagcttggtttcaccttctagggggagaaagggttgctcttaacaaaaactaggacaataaatttaaatgtgtttataaataatgatgtaagacaactatgtcaatgttgttaaagttggctgttacttttaagtacaaaattgcatattccttatttggtgggattactgtacatagttatttttagaaatcagaaaagttaattgatttactgtgattctctcgttttacaaaaatgcaaattgttttattatataagaagagtccattttagaccaaattcattcccataaaatgaaaacttcttggaaaaacaacaaaaaagaactttttaagaaaatgtattgattggtaactcatgacatttcttttctgttttgctttttggctcctgtgaatctcagaaaaaaaaagtctgttgctactcaggaggctgaggcagaagaatcgctcgaacctaggaggcggaggttgcagtgagcagaaattgcaccactgcactccagcctgggtgacagagcgagactctgtctcaaaaaaaaaaaaaaaaaaaaaaagtctgttgcttgacaatggctaaccttagtagaggttttgtggtacagttcactgatctttttccttcattattcagctttgttttcttgagttttatattaaatgtttttaaaaatattttggtaattatgcaggttaataaattataaaggatatctatagttttccccatctctttctggcattctaatgacatgaatgcagattccttattgatccatataagaatgagctcccagaagtgagtgtaatggaatcaagtagccagaaatacttagtaattggattgtttttcacattctgcactcaacttttatggaaaaaaaaaactcgaatcaaagtatatcaataagatgataaatccattcattccttttcagtatccagtccagtccatttaccagggagtagccaccaccatctgtgcctcaatattttcaaactaaacaacaattgtagtttctgtgcttaaaatattgatggaattagtgattccccatctccttcgtatacatttcagactctttatctgtcctacaagaccagtgtctcccacccttgctgccttgcttttaattcctcaaacagtgagatcaccatagagcttccggcccataacaggtcagcaaagtcttagtcatttaacaggtccaaacttaaataccacttccttagaaagcctttcttctttcaaccaaaattaagtcggccccctttaatgatacctcttagcacctctgttctccctcctagcactttgtgtacattttaactacatattgctttctatttgtttgatgccagtcttgctccacttgacaatattctcatgcccataatggtgtgactctggctagtttgttcttcattatgcacccatcacctggcacgatgcctggcaagggagtaaaggaggatgggtagatcagtttttcagggaatataaaaatgacagcacagttttatcacaaatgtttaatctttctgtatttccatatttatagcttggagattgcatagtaaacaggaaagaggatgaggttttgaatcaaaattctcatgtttgaatcccagcctggcacttagcacaatcacaaagaactgtaggaggaatgcaatactcacatcatctaattcatggtatggctgcaaggccaaatgagaaaaatggagatgcattcaaaaggtgagagctacatgagaattcatgaacacaaagaagggaaaaacagacacagggcctactcgagggtgaagggtgggaagatggagaggaacagaaaaaataacctttgggtactaagcttattacctgggtgatgaaataatctgtacactaaacccccatgacttcagtttacctacataacaaacctgcacatgtacccctgaacctaaaataaaagttttttaaaaagtaattgaaatgttcgtaactcaaaggataaatgcttgcggggatggataccccattctccattgtgtgactagttcactttgcatatctgtatgaaaacatctaatgtacttcatatatatatatatatatatacacgtatatatatatatatatacacatatatatatatacgtatatatatatatatatatatacacatacctactacctaccctcaaaaattcttagaaatttttttaaagaataaaattagacccctatctctcaccatgtacaaaaataaaatcaaaattggttgaaaacttaagtcgaagacttcaaactatcaagttactacaagaaaacattggggaaaatctataggacataggtctgggcaaagatttcttgagcaatatcccacaagcacaggcaaccaaggcaaacataggcaaatgggatcacataggttaaaaatcttctgtacagcaaaggatgcaatcaacgaagtgaaggaacaccccacagaatggaagaaagtatttgccaactatccctctgacaagggattaatcaccagaatatataacaactctataggaaaaaaactaataatccaatcaaaaaatcagcaaaatatttgaatagacatttctcaaaagaagacatacaaatggcagtcatatgaaaaggtgctcagcatcatcaattatcagagaaatgcaaatcaaaactataatgagatttcatctcaccccagttaaaatggcttatgtccaaaaaacaggcaataaataacaaaagctgtcaaggatgtggagaaagggaacccttgtaccctgctggtaggaatgtaaattagtacaaccactatggagaaccatttggaggtttctcaaaaaactaaaaattgagctaccatatgactcagcaatcccattgctgggcatacacccaaaagaaaggaaatcagtatgttgaagaaatatcttcattcctatgtttgtttcagcactgtttacaatagccaagatttggaagcaacctaagttgcatccatcagcagatggatggataaacaaaatgtggtacatatatacaatggagtactattcagccgtagaaaagaatgagatccagtcatttgcaagaatttggatggaactggagattattacattagatgaaataagcctggcacagaaagacaaatgtggcatgttctcatttatctgtgggatctaaaaatcaaagcaattgaactcatgggtttagagagtagaaggatggttaccagaggctgggaagagtagtggagggttggggagaggaggggatgcttaatgggttaaaaaaatagaatgaatgcataagacctactatttgatagcacaataaggtgattatagtcaataataacttaagcgtatatttttaaataacttaaaaaatgtaattagattgtttgtaactcaaaggataaattcttgaggggatggataccccattctccatgatgtgcttgtttcacattgcatgcctgtatcaaaacatctcatgtgccccaataaatatacctcctatatgccacaaattaaaaaaaaattaaaaaattaagaaaaaaattgttctcaagtgattaaaactaagatggctgggtaatttaagctctgtattgggtataagcagaacatactttttctaaaccttgtgaattttttaagtggttacaaaatattataggatcagactttgtaatttcataaatattattattacaaataatgtatccagagcgatctcaattatgaagtcatcaaggatgggtaagaaaattacagagagaagcaataaatctgaatgtacagtgcttatcttcaagtaacttaaaaggaactatgaacaaatgttcatagttttttgggatacattaaatgacttagtgatacttaagaagatactttgattgatgttactaagaaataataaatgagtaaagcatgattgtagttatggtgtgagtaatgatatgacaggatcatgtgatagacattgggggtaagataaagatcataacaatagcaaacacttatatagtacttatgatgtgtactttattatattatgtatatattatattgtgtaaccacttgatacattaacttatttaatcctcccaaccacactctatgaaatatataccatcttaatctttctttcgttgatgaagaaactggggcacatagagattttggtacttgctcagtaagtagcacaatcaggatttgaacccagataagttggctcttaaccaatacacagatctgcctcttttgtgatttaatcaaaataaactctaaataaagacattacaataaagacattaattagctgctaatcagctaattaagttaaaaatgtaaaaagtgctaattgaacataaaggagagtgacaaaagtgtgaaatgttcaggattatctaatataataaaaagcttatcaaaggtaaaaaagttttcattggaaaagattcatgaacaagcattctagaaattaagaaatggtaaatggccaataagcatgttgtaaatatttcaatcatagtcttttggttttcagtgctatctatagactgacaccttccttatgtatatgctcaggcctaaacacatgaactccagtcccccgtagtcaatggccttctaaaaatatcttaggcaatccagaaccaacaaattttttttcttcctacaccaagtgtccctcccttagaccagaagcttaggagtcaagcatccttctttcattctctacatccctacatctgttccatcaccaaatcctctatgaacaatactttccagactcacgtcaatgaggcttctgccttgggtctgcttcatttgtgcttctcccagtgatctgcaaatctcaactcagataaaacctcatcagagatgccttccctgcctatcgcatctaacatgctaactttgctccactccctccctcatcactctcaatgcccttatattagaaatgcttctttttttctcattaaatgttagtagactttatttttaagagcagctttaggttcacagcaacatcgggcagaaggtgcagagttcccatttatccttgcctccacacgtgtatacccttacccattatcatcctcttccacagagtggacctccactgacatgtttttattacccaaagtccatagtatacactaagattcgctcttggtgttgtacatcctatggctttaggctaatatataatgacatgtacttaccattatagtgtcatatgaagtagcttcactgctctgaaaagcctccgtgttccatctattcattcatacagccctcccccaacccctggcaaactctgatcactttttatcgtctctatagttttgcctttatctttttttgtctttcatctcacccctcttaataaaaaccattttaatttgttcattactatattcccaggttatggaatagtgctaggcatataatagatgacttttaaatagctgctgagttaatgaattattatatatatacacacacatacattatatcagtcatatgtaattatatacaaattatatgacatgtagatatataatatatttaatgatatacttgtattattattatatatgtatatatagatatatataggcattatataaaatactcattttgatggggatactgggaagtggaccactcatatcttagtgatggtagtataaattcaatgttctggaaaacaattagtcaactaatatctgaaatagtagagcattcatcaacgtttacccgataactctaaaaagtgtccctaaagatgcatcattctgtatccatcaatgtcagctttgttaagtgaatgttccacatctataaaaatagtacatgcaattatttgaaaagttatgctaccaaaaatactgactggcatatatagtaaagcaaataaagtttactaaataatatgtaagtattcatcttaatgtttttcttaattatgtgcacatatatttgtatagaaaaaagacaggaaagattatctataataattttaccatggctatctctgggtagtgtaattatggatcattgttttcttcatttgttttataatctttaaagtttatatcataaacatatttgtacttaggaaaatacagatagtacttttaaaagagttctgtttagttctccaagaactaaattttatcatttgtttaataagtatttcatgagcaatactaaactctcaaaatttgttaagtgctctgaagtttacaaagataaataaaaagcatatctgctctcaaatggtttatgttatcattaccttggtttatcatgggacaaagcaataattagacttaaatttaaaatttaatggggttttgggagatgaactatggtcttgaaaacaaaagggacatgtatgaaaccacaggtttctatctactattcattgagacgttgcttagccttttctaaactcagtttttatatctgtgaaataagaacattgagagaaacgaatgataaaatgaatgtactctaaagtagtatttcagatttcatttgataatacctccaagcaattaatctcacttatgttaaaaatatttttcacatttttttgtaatttatttgtaaatagaaaatatgttcgggattctaacaattgttgggataatgacagaaataattttctctgcagatctttcccccatcaactcatccatctttcccccatcaactcatccatctttccaaccattgattcatccatccattcatccagtttttataggatctttcctagacaaagcactgtgttgggcaccatggtatctctttaattacttttctcctttaacagtcctttaagactatgtatacattagaaaataattaatctggtatggtcagctatctatatgaccattttgagtcagctacatagctgatatgaatgaacttgatgaactccaatattaagcaggccaaaattaagatgctcagtgaagtttcagcagcatcacttgaagaaaggaaagtcagtgccttcctgtgttgggctgtggcccaaacacacaaggagtgtaagtttaaaaggcattctcaaactggaacacatccaaatcagttaacaaggctagaagatggttgagaaaacatactatatggaaactagttggagagaacagagatgtttaacctgaaatggggaaatttagtggaaaggaaggcaaatgcttaaaaatacctgaggttctagcccacgaatggtaccagaggcttgctctcagggattagaggtaaggttctaaggagttcagtgttgttagcatgaccaaccatatgcactttttgcccaagatagtcccagtttatgcctgctgcatgcagctcagttcactcctattaattacttagagtgccccatttcactcagaatgtctcaatgtgaacaaaaggttatatttgccctaagttttgtagaacccatacaattctttgttctacatcagaaagagctttccaatgataaagactattcaataatgtgatgggacaacttgccaagtgactattttcctgtcactggtaaggcacaagcagagacctggggtcacctgtctgggatgttctaggtaaggattccttatttggtgagaggataaagttggtgacttttaagttttctgccttctgattttaagattctgttgttttgtttttgaatattctatggtcaaatatcagttccatgacatacctacgaaaacacaatttttaaaatatactctttctctcgctaacatgaagacttctccattttacatttcattgaatttctgtggatgttgactaattctggagatgtggcaaattcatactagtagttctgtgtgtgataccttgtggaatgatgggaatccctgctatgataaagaaataagaccgggaggtactgtttaagaatatgacctggacagaaaataaatccaacatttattgaaatttgtttatttaatattgtaaatggtttgcttttatatagatttaatatatttaatagttattctatattataaatcattcactatagcaggctgtttcagggtgtaaaattaagagcgcactgcctttgaacttaaacggcccatgttagaatcctcagtgtgccagttacatcagttctgcgatttgaaatgaaatatttaacttctctctgagcctcaccttattccgtatatcctacaaagagaaaacactacaattttggagtgtaattctgaggattagaaataattatgttaaataaccttgtacacagtatgctttcaaaaagttcgctctggtgaaagactgttttgtgaacatgaaatctattttaacctacttgtcactatttaatgctgctctgtttgtgcatccttgtgttcaaggttgactgtccatttgttagcacatctgcatattcctcataattaatatctttttaaatgacatatggtttagtgactggaaatcgagtcttgccttctgttttcaatttgttcatgactcaatgactcaatatatgtgtctgaactttaattttccattctggaaagtagaatttaaaacccttgctcatatgtagctatttcggaaaatgatgaagaaatgtgtaatccaaggattttgaatatgtgccaggctattcagcgatgcagcatataggtaaaaggccgcagtttctctaatgttaacagagaagcctaaatgagaatgccaaaaatgtaatccctgaagtgaggggataatttggggtaggctagagtcagattcctagtgaattagcaagaagcaccacatctaaatggaatgagcacaggaagagttggtgggagccctagggaatgaggctgagaacatcattaacctggatgaacaactgatagtacccccagggcagtgcttctgcaagccagggatctctgaaagacaaggcccagtgcacccctggaagtgagtttctaacttccgagtcccccgtagcatttatacctcttttgtgctgagtactctttttttggtgatacagttatttgagtcaggtctaatctgttaaacataaagtagattatttgattccgccttctacctattctgccctttccctgcctctaacaagaaccttgtgcagagtggtattcagtgtcttgtattatagaattgaatttgatacaaaatattacaggcttatttgatattttaatgcagcattttatttcactattttgaaatgcacacacacaggcaaaaaacaaaacacacctcaaaagtaacatgttggtgggatgtcctgagaaagaattcagtgcatatggaaagcacagtgaattcattttctccctaaaatattcttcttcttgtccccacagacttggtagccaccaactacgtttgtaaagcctctgtttttgcctttgagagctcactcccagagttttataaatctgcagggagcaaaggtttaggacatgtgtaaataaatcattttatattttttcgtttgttttattttgttttgttttcttagagaagtttaggacatgtataagtcattgtctatttggtgttttgttttcttttgtttttcatatagatgagagtccagtggcgtatatcatttttaaagtttaataaaattatacattcaaaagattataccatctcaattattccaatctgtgatttaatttattgcttaatgttttgtatgaatttgattttctgaagcaggttaaatttgaaattttattaaaaacccacttcctttgagtttatagattgggatagctgttttatctagtcgctgtgtagaattagtatttactggacaagatgtgttgattcaggaggttgtcttggagtgtttgccccgtgagggtcatattaaacttgagagaagttctttgagcaacagagcatcttggagacaatatatcaagctgatggatacagggctcttctgttaagaaaccagcagtggaattatggctggctcccagttattgctttggtgctaaggagcctctaaggattaaatctaggataaaaggggttaaacagaggggaaaggaaggtttccagaattcagtgttactggaagcatacagaatgagtagttatatacaaataatttaagatgaccattctgtttggaaatatttcacaatttaatatattcaaagtgtaccaatttagtggagcatattgttttgttattactcagaagagaattcgtgacatcttattattattataaagcctactttggggcacttcttcctactgtcttaatagaaaggtaatgtagtttttaacacataaggggttttgtgtgcatattaaaaactaattttttcagggctaatgacttgaaattcagaatttggattttcaattacattatactccttgatgtagaaaaattagacaaaaataatcaaaagagagacatggttttatatgttatacattgtatgcattttgcactttattttttgcctgtgttttcacagtgctcttttttctatgtatgcacttattataaatcaattaaagtatatatgtcaaataaattatgattgttaaaaaccatttgtgttcatagataaaaatatcaattaaaaagcctttagcaatgaatgtccttcaaaccaaaaatgtgaaggtaagaagtggatagttggccctggacagcaatcttcttgcactttctagtcatgccacacttttactaattgagagaattatttcatatcatttcctctttcttcaagcctccatttcatccacccaatttgtcactgagcctttgcttttattttgctcactaagaaactgcgcatcatcaaaggagatctttgctattattccatcactgaatctactcactgctctacatcttcatctgtgcattcacttttgcacaatgggagaactatccctgctctgtttggcagccagtgtgcactgactctcagttgattcaaatgtgcactggctcacctctctcttcccacactaggactttgctctggcaattctttcttttacggtatcatttcccctaatctgtgttagattcttccaacaaacatgcctatatgctgcaacatcttccagtctttagaaaaccttcctttgatatcatgagcttttctagctgctgccccattttctaatcccttttagaataaattccctctaagtgttgtctaagctcactgtatctgccctttaccccctcgttgtcttcacaaccttagctcagactgctatgcccagcactgcactgcatctgctctttgcaaagttatcaaatatctgcacttggccaaatgcaaagtttcaactcccagtcttcttcctccttaaactctcagccgagttgatacagctgatacgttcttcctttttcatgtgccttctttctttactcggcttccagtctgcaccttctcagtttttctcctacctcactgaccattccttctcagtatcctttcctagagaggcctcctcctgacctcaacattttggtggattccagggcttggttctcagacctcttctatactcattctatcaacactcacttcctagtttatttcaccatctcagcctttaaagatcacatatatgctgacctacaactcctatgaaggctacaactcctatgaagacttttcctctccctctcctccttagtccgtgttagccacactgttccttaaacacaaccagaatgttttcctccttactgcctttgaatgtactgctatctctggctggattactcttcctccagacattcggatggctacctccctcatgccagtgaagtctctgttcaaatatcactgaattgcattttcttcctataatcttcccatcgaattgaagttgttacctagtaactaaaactgcccaattctttttaccttctctttccttacactgctttatttttctacaaagcacttatggccacctggtattattgtatacacagtattcatttgtttaccacctgctccctccacttgaatgtaagctacctaggggcaggagtggtgtctattttattcagtgctgttcttcttccacatgaagagtactgcttagcacagagtggagccttaataaatgtttattgaacaaatgaatgaattattaatgaactcaaacccattacagcagattgatgaaacatgtaatctaattcttctgttctcatcactggtcattcattagcctcattgttcacagacagcttcttctgaattggagagtatgtaaaattgacacactacacaaggttatgtataaaataaagttgaaaatggaccctgatatttcatttgttctcattattttgatcacttctccttcttcaccaatggcctctggtaatttgtggtcattaggaacctatattacaataatcagaatgttcccaacaaagtatattatactagcaattaaattatgctaaagaaagttcaggtcagtccaatgtaataatagtaataatagttagtgactaataattaccagggtctaaaatcaggtgctttatttatatgatctctgaacttcacaacaattctataaaggaaaaatattatacctactttagagatcagaaaatataggctcggagtcattaggtcattttcctaaaggcagagttttgctgaatttgctttcaagtttctgaatagctttggaacaaactgatatgatttggaacaagctgatatgacaggctcatttgagttataccagttggaaaaaattaattaaataaccagagtcatcttatcaactttttttagtagaataggctttagttttacacattcctgttaggccttctagaaccattcaaagagatttccctggtagattgtaccaagcaggtatgttgaagtcagaacagatttgccggagactcaactagactagaaaaagtggtatgcatgttccaacttgcaaaattgagtaagggcaggagaagggataactctgagaagggtaattgtataaaacacatagggaaaaaagtttactttttatattttcatgggtgagcattaaggctggaatacactgtattcagccattcatgtttatttatcattccagaaaaatacaattttagctaacttcccttcctccaaaaaaaaaaagaaaggaaaagaaagccattgtgttcacatgtagtggtgtgattaaggcagcaatggatgatatcggggggaagaatatgagatctggactgcttcagtgttcaattgtttggtctgttgaacaaagagttaaatgaaaaaggtactttaatatttgcttcactaaattccctccatgttttcaattagataaacagaagtacaggtgggaatgtgctgcatattcatttgtcttgctgtttgggggccggcttttaagactgaaatactaatgtaattgtgttgaaatgaacaataaggaagtacaggagttcaggaatgaaaatgttaaattaaatggaccatgtttaacattgttgttgatcctgaggaacagtttttccagtatatggagcatttcgattccatccagcatatgttctccacagttttctctgctctaattcatctgtgtttttcgacagctccagatggcgtgctgcctcccaggctttcatctgccactccaaccagtcttcaggttgtctggtctacaccagctcgtaataacgctcctggctctcccagataccaactccagatgaggtctggcgactccacccatggatttctagagtgagcattctactttgtccattctatcagctgggttatacaatatagacataacatttttgaagagtaggtcagttctcatttgcaaaaaatataggttaccttttaaaagtacaaaaaaaccccaaacaattagaggataatcatttgctttgcaaaaatatctatttttcatttatgtagcatttaaagtaggatttcttcccactgaaacttttcatgagcacatgcattacataaagcaatgaaactaacaaaatgatgtctgaactgtcgctaacaaattataatacctattctacaaatccacatggcagtcagtctcaatactactaggatttacatctcgtataaacacaagattacagactcagccaatggctacttattttaaaagagatctcatttgatggcagaaaattacaatacttaaatgtatgttgacatcctctaaaatttttttgtagtaagaaatttacttgcttttatttctttgaatgtcgaaaacttcctaattgacatttatttcccatacaggttattttccaatccttctgcatcgttaagctatgaagtgagtgatctccaaccgtacacagagtatatgtttcggttggttgcctccaatggatttggcagtgcacatagttcttggattccattcatgaccgcagaggacagtaagtggtctgaacaatacacagccaaatgtcttctacatagggagcttaaaatgtcttcaattttttccaaagcaaagaaatgagcctcccttatttacttgttgtttagtgacaataaccttttctagggcaagagagtgagcaaaggtggtcagtctctccagaaagaagaataatgtggtcttggagggttggagggttaggcctacagacaggacaaagtaattcactataaattatgatatggccccattctatccttcagggtacatcttagcgccctgcaagagaaaggttgtcatcttctgctttatgactgaatgttctctgtttcggagaaattctggcaggcagaagaaaatgaaatatggaccttacttcatgaggctgcttacatatacttgttcctggaaacaggtttcattttcctgcttctactcataccccaaagacagccttcagcatagagaagtataatctgatagcagtatattacaaaaggtggattaagatttctttattcaaccaataaagagaattttctagttgttcactaaaaagttatttttgcatatatttgctagattatatttgggaataaatacatgactataacatttggttttatacaaattacctctataaaagcatatatatgaaagtagaggggtttttaaagaaaagttagaaattaaatcaagctacacagagtgaataaggacattgtatctttgaacagttaggttttttgagttaatcttgtgaagtcttttaatcataggcttcttaggcaatgttctctgctggcccattgccatgctggctctatatccaatgagaacgttaagtgactttcaaaagcctagatattaacacaaaagtatggtatttgcaacaatatcaattgtttattaaatgtattgttttatttctataatacctttaattgcattattttagtgaagataagacatcaaattagacattatcagtacaatctatcttgtttaaagttgactttatttttacaaaaaaaagccacctttatgagcaataatgtatgttacttaattcatttcttccaattcgtaattactccctgggagaaagttagctactttgcaaggggacactcagtgtttttgttctcaagggtatcatttagtaaattatcagcacagtacgataaatggcacccaaagtccagaaagcattaattcaccaccttttaggaggaacattacatacactctggggaatctggacaccatgatcaccagatttatggactgaagacttcacactcaaaatagatttttgaagaaacatttgaaacaactgaagatagatttgtaatctccttcttatatatagcagcatgcttgatggcactaaataaagattagccaaaaataattattcaacccactgcagaggtgatggctcaatagaatgcttggaagaagggagaaagcattttttttttggcacagcattctttattctcctagagaaagggcaacactcaaacttcctcagcggtaatctccccacaattttcactgaatgagggccatgacctgccatctataggcagggaggtagcacataaataagcaaaagtccaaaatattgtaaaataccaattagcatagcatcctttgttgagcaaacttacctttggtctcctttttactataaaacaagccttatagaccacacatacacatcgttagaattttcatacccagagaccctccattgttgtggtatttagggcttgagtttaaagtgagtggtattaacccttcattttccttaagtaagaattagtaacacttgaataaatagcaggtatcaactcataaccattatttgtgtttaaatccgttccccaaaatgaatgaactcttccttcctctgctttgtgtatacactgtgaagtcacatacatagcaaagaactggaaggaggccatgtgtacctgcaggttacgttagcagtgcacctgagacatggtgacagggtactgtatattttagatgtcagtggagatggatgccatctctgaaaggatatgcaattgagttgacaaagactgagtgattggcattgggcacaagcagtttttctgtcaaggctacaaagcattgcttataaaaccacccatgttgacagctccatgccagaatcacacttcttacttgatcctgaccagcacctcctgctcaccaaagtgcaattttctttctctttctttcttctttctttgtttctttctttcccctctctctctttcactttctttctttctcactctctttctctttctctctctttctttctttctctttctttcttttcttcctttccttcattttttgagacagcgtttcactctatcgcccaggctggagtgcagtggcaccatgtcagctcactgcaacctctgtctcctgggttcaagcaattcttctgccttagcctcccaagtagctgggattacagatgcccaccaccacacccagctaatttttttaatatttttattagagatgggtttcaccatgttggccaggctggtctcgaactcctgacctcaggtgatccagccgcctcagcctcccaaagtgctgggattactggtgtgagccacctcacccaacccaaagtgcaattttcaatgtagaaatttcacatatcgtcttacagaacgaaacagagaagtcgcctcgtgcccacatttaaattccataccatcaacaggcacctttctgcatcagccacagcctcacagctttccagtgccaaaatgggtcaccaatggcaatatttttagtgtgacatttcaagacagtgattttcagcaagcctgtgacacaggtgaaaccacaaagagaaatctaggcaggcaatgagctacagccagagaagcaaatgcatgggtgcagagaagttatcatggacagggaaacaggatgtgaagaattttaatagatttttttttcaaataatttgtcatttacaccagtgtgccaccaatatccagttccatgcatttttaaaaatctagtgtgctgatgccaaataatcataatgcacatttcctatgaatattttaaatcctgttaaatgtgtgttaataaaagatgtttgttccagccaatttggtcagtgtagtgtttaactggttgcaaccagataaatacaaacaacacattattttttaaatgtgctgctggcagtccaagcacctggcatgtccacagcttgcaaaaatgtcctaagattatgttaggcttgggagcatgtgattaataaaatgaaggcacttgcctagcagctgaaaatgttgatatcttgaaaacaaagataaccatcactcctgattatatgattgttccttctctctcgtatgtttgcaattgttttctgtatagtacatgcatgtagaaattagagttggcagggagggcaagtttttcaaacctcagcttaaatgtggatgtattcttttgcctaccgaaatcctgccttgtgttaactatgaattaacctactttttcttaaaattgtggattccccagcccaaaaaagttagataatctgtttctcttaagatttcccaggaaataagattgaaatatggaatatctaatttcagtcattttaatgacaaacatatatggcatacacaagcaattagatcaactaatgaaattgaaatcattttctaaaaatcacttccctaccctcaaaaaaaaaaaccccaaacttgaattcactttagattttaacaatttagttgtcatatatttaaaaatgtttgatcgtttcccaaatttgtagtttaaaattccatatttatatttttaaccactagtctaagaggcactactgcataaaacctgtagaattcgaacagtttattctgtaggtttacttagacaacttttcatttgttcattattttgatgacacagtgatattttaagtacagttatatgctgcacaacatttcagttgatgatgaaccacatatatgacggtggacccataagatgatgatatcatatttttactgtaccttttctgtgttgagatacacacttatcattgtgtgacaaatgcctacagtattcagtacagtaacatgctgtacaggtttgtagcctaggagcaacaggctataccacacaaactagctgtgtagtgggctataccatctaggtttgtgtaagaacactctaggatgtttgtacaacaatgaaatcgcctaatggtgcatctgtcagaatgtattcctgtcattaggtgacacaagactgtaccattgccatgctatatttgctcattgcattacatcttgttattttttcacatttataattgcactgtgaacagaggagagggcaatgaaggaaattgtcttactgcctgggtcctgctttacttttcccctcagcaaccttcatccatccttcagatactcacagtaatttacaaaggaacagaggttcttctggagtaagacagaaaggcaatgtgaggtcaattgaaatctagatctaacagaacatgcttcttcctcttttgttgcctgacataattctacacattcatcaagccccagctcaagtgtcacttcctctgtgaagttttccttcttgttgctcccttagaattttggtttgtgtttactagtgaatcatcaatatccccttctgaattgtaacgtctcaagacctagggatctgtctcaactatctttctatcaccagtgtctggcgaagggtctgatatagagtaggtgccccaaaattcttactcaaagtactgattaaaagcagagtttgattgaagtaaatccacaaaaactcaatcaagcaaacatttaccgtgtacctactgtgtaccagggactaaaagagatatgaaagttgcaaggatggatatgatactgtttttcccttgagatttcctctgtctggcaaggagcacacacagtaaaaccatagttagagtgaaagagctgagttgtccatgagagcaagctcagaggaagggcatggcccctcaacatgagggccaggaaagcctacccagagaagaccaggagaggaattggaaatgatttatatttggagtgcactttaatatcaaagttcaaatttacaccatctccacttgttcagggtaaggctggaaagcaattgctgtaagagagcactgacatatgagacctgaagagggactctcaggttgtcctgtcggtcgttccagcctctgagtatgaggcgaggagggtggggacaagaggtgaatgtaagagagggacatcccaaaagtgattctcatttttttaccttggtcagaggcaggcttctggctgtccctctgattcaatattggctgctgtcttggctaggttaacgaatgttctagttagagaggcttctgccagccccaaatcatgtgctattcggaatgaaggggagggatgtgtagaaagaattctaaaacaaaaccatttttcctgtttttattctcacaacctgtaataagagtaaaatactctgagaccgtgtaacagaagaggaaggaaacatgtggtataaaatttgataaattgatcaagataattctagagtaggacttccgaatcatttaagtgcacatatgcccttaagattactgaaattttaaaactaatattgcatgacaaacatcttatgtttagggcattttagaatttaaagtttcacttgcatccttaaaatcattctacgcaacacaaggaaaatcggaatatttttaaatgagagtggaacatatttatatgagtacattttatttaatgaagaaagaggaactacaagtttcagtagtgctacacaactattttgctttctccattccaaatatttttccagttgccttaagtactaacctctgattgctgacatgtttttcctttcaaacagtaattcaggtatctattttgcatagaacagaagacccatgatcaaaaataacatttataatcttctgattttgagagcaaaatggttctgcatgttttcactacatactttgttttctgttgcatagattttctccacaaattcctgaattttcagaattaacaaattcaaatatttacaattatttttatattttatttttataatgtaagatcaaaaggaacttattcaagccaaaaatgaccaatacggaatcctttgaaaggatggattgattaatcaaaaattctatccaccttgcctcaatttcccacttaagctctcgaatctcccctgggcacttaaagcacactcctcttccaaatatagagtgcttgtaatgtctgtgtttcttacagctgaagactgcaggtgaaagtaatgaaaaatcaagttttttatgtttactttaagaaattaatgaaaaataattttatcatagctgccttattatcactacttaaattttattgagggtgtattatatgcaagacactttagcaggaaaagtatatcctctcattatccagaaatgctatctgctggccttccactatttttaaaaactattcttgttctttagctttgaaaaagttaaattgtcaatatttgaaaactctcagtggactatgtgagatcattcaaagataattgccacaggttgatatttaatggcatgagtttagttttaattctcaaatcttaaattcttagagagtcaagtatctaaaaactgctggttattaacaaaaagatggatgtttaccataatcattttctatagcattttctatagcacctgcctataaaagaacattctgcaatgctaaaacaatacatagattcatttaatcttgttgtcttcctcattttgataatgtacctgtaaacagagttgatttgctatatttggaataattcagataagttttgcccaaatataaggagtgaatgtgatgacctttaggttttttaggatgttttcctgacttcatgaattctcacatcaatgcattttattttctgcaccaaattatcgcagatgcatctactacgattcaccccacaatatgccccagctctagaggttgaaacattctttctaaacaatactctcctgatatcaggagaaatagagaaaaatagttcccgaatattggttctcctatttgcaaactatcaaataatgtccttccaattccaacagccttttagccttcagaggtttctttcattaaataatgttacttatgttatacagcccatttccttttttatcagagtcaggctgaaagttcatttttctgcaaaactgcagtgcccattcttaatttttgttttgagaaataactgttgtaccctctttattatcacaagattaataatatttctttattttattgctcctcttacatttggatcttttattatgagctgtcaaaaattcttttgggaagtagttggggtataaataataaatcgataaaagaattcatgattaaagacaagatagaatccattattctgttaacatatcagtagtgaataacaaaaggctacattgacaattagcatgcaatatattgctttatataattatacatccatatatttgccactttgatttttaattcactggtaaatttaggggatactcatttatggagttaatattaccaaaaagagtttttaaactgagcgaggctttaattagaatggtaaaatattgcttcagggcaacaatgagaatgtaacaagaaaactgactgatcagtcatgggtaactcgaatagcaaacaagtagagaagactcacaaaaccactgaaagttatatacacactcaagttgtgagtcattcaaactgggtattcatacacatgtatacaaatacaaacaagtgtgtgcgcacacaccctttccaatatacacacctgaatataaaactaaataagcagattcctctgttaacaattttattactctattttaggctggggctgaacttttgaagctgatgagcaaaatagtttcccataaaagataatttcatttgccaaaatgaaactactttccgttattaatgttgcaatgaaatggtttgaaatatgagtctgtgatctggacagaaaggatgctcctgttcccagctccaagagggagttctctaaacaattacacccacggagagcgctgtaaggttgtattttcatcaccggccagctgagctgtgtgcctgtcatactcccagtctcccctccagtgacagccgcattgacaacatgttatactccacattgattttacagttaaggagctgattgtgatatatagagattttaagaattcagctgagaggctgacttttgccttttatcattccattaaaattttataaccatctttttcatgtcatttcatccatgaattcttactttagaaagtgatagctactgctgtgagcataacttttctcatgttcagagctttttattgtattagcaaactaccccaattatagttattactcatgttttacataattgtggtggccctttcaaccatgcagttgcaggccagttgatttgtatatagaattagatgattcggcttatcattttaaagcactaaattgaaagagtgccaggagtcaggttttaacacttccctagccaaaggagctaattaagctgctttcagcttcctctccagaatcacacaagttaaaggacccttctgcaacaagagcagcgaatctactcagccagagcaggaagctaataaaatgtatgctggcttttaagggggaaacaaatcatgaaattgaaattgaacacctctcctttcccaaggtaagagatcatctttaagaaaaggctgtgtattgtgggggtttgaagtgcaagttcatctcattatcatggatgtttcacccataatactatcatcatatgcaggagaaataaaagccttatcccccaatcacagagaacaaactgcatcattgttgtttcttttccctgaagatgctcacagtttgatagttcacatatgaggaataattatgcaagacccagatgaaaaccctaataaaaaatattctgatttttaagtgtatattactctctttggggaagagagggtgagataaggttagacattaaagacttgaatctccaccattgattttacgaaacccaatctcaggggatttgggggtttttttagatttcaaaacaacattgatatcttacaagactcgtacttgcttttctctgggaaatagccaaatctagatgacaagcataaataagaaaggagctgtatccccattttgatataataattgctactgctactgtataccagagagcaaaagtaagaaatggcatagtggttttaagaaagctttaaaatgaaagctaacaagagactgaaacggaaagtgtgatttataccatgactgctggttttagggttttttttagggatttctcttcaaataggatacattaccaaattgtcagaaatagcttgatttcagagttagtgcactataacatcttttgcttcgaaaagtgattatgattctaccatcagtccagttggtgacaaatacgtggatcctgttgtgtgaaagtgtactcatataaccaactattattgcagtcactggccctgcaaagcagtggttgcatttaaaatttcaaccttctttgtaacactgaatcgcatacacacactcacaagatcaacgctgttttaaacaattactaaatccaagtatatcttttttaaagattttcaataaaatctaatgttcacagaaaaatctcataaatgtcaaaattgctgtgggcagaaaaggggggatacagtattttcttgatctgttttagcaatttatagatttcaggccgtggtttataagaatgctaaatgttctggaattacagctgttactgatcagtgattgagccagatttgtgttattgcaccatgttcttgcttgtacctagagagcagtaaagcctcaatataataaaaagcacctgcattttaaatgaaatttcaattgaaaaacttaacagcccttcaaattgcagaatttaacgcagcccagtaaagcttaaataacactttgcccccgcaggctgaggggtttgcattcaaggtgacttgattgtgtcgcatggtgaaattatttacaattaaggaatttctctggagggctgcagaatatttgctgttccacaacacctatgcaggcatatggtgggcctttttcagtattcatggagcctcctgaacctttatgataattgaatcagttagagtgctgagtggagcaagcataaaacctgttaacctaaaggtcagatctgtgcattgtttatttatcagtaggtgaaagagctaaatcggcagcttctgtcacagccacagtaaaaaatcgcctataatattaacagggagtagataaattgcaaaacatggattagaatgataaacagaaccaagtataatatagaatatataatgagagatgctgaaggattttactgggctgtaaaatatgcaagtttgttatgatagtgttattgattataattagttactggggctctagaaaaaaatgtaggggaagctagaactttagtaacaactaccctcttgtatgtttattaaatttatttttttaaatcctcattttttaaccaatggcttgaataaaaagacatgattttgataaagctgtcttagagaggaaaatgatcattttagtttcataatattcaacaagtatttcacacgcaaaatttatgagcaaagcaatcacagtccttgtctttatggcacttatttatttacttattggcctttaccaagtgttcattttcatatccttgtagcagagctatcactcattttagctttgaggagaggtgggacatttccaagaggtctgactttctggatttattttactttacagaacctggacctgtagttcctccgattcttctggatgtgaagtcaagaatgatgttggtcacctggcagcatcctagaaaatccaatggggttattacccattataacatttatctacatggccgtctatacttgagaactcctggaaatgtcactaattgcacagtgatgcatttacacccatacactgcctataagtttcaggtagaagcctgcacttcaaaaggatgttccctttcaccagagtcccagactgtatggacactcccaggggcaccggaagggatcccaagtccagagctgttctctgatactccaacatctgtgattatatcttggcaaccccctacccaccccaatggcttggtggagaatttcacaattgagagaagagtcaaaggaaaggaagaagttactaccctggtgactctcccgaggagtcattccatgaggtttattgacaagacttctgctcttagcccatggacaaaatatgaatatcgggtactgatgagcactcttcatggaggcacaaacagcagtgcttgggtagaagttaccacaagaccctcacgacctgctggggtgcagccacctgtggtgacagtgctggaacccgatgcagtccaggtaagatactgactattctctctcctttgcagacttaggaatgtaccctggattgactctgtgttgaacagagccatctactgactaaacaaacgcatttgttgttttaggcattcactggagaaactgggttttggcctttggcccaaactatcttaaattcgatgtcagtttttcatttatccctgtatccccttaattatattgttgagatgcttccatttgcctcgcacacctgaaatattttgaatgccacaatgatgcttagcttaaccaccacgtcagatttaaatagatcagaaaatgagaagagatgggaaaataaggaggaatgaattagcatattaacaaaattttccattaccaatagtctggtattttttaataatcaaagaatcaaagtaatggggaaagaaataaaaatagcatattaacgggctatccagaaagtgttcaattattcacctcattctattgggaatgaactctagtggacaggataactaccattgttttggctggcatacaaacttcattcaagggaaattagtgtaaccaaacaggagggagttttgtagcttagaagcctcttttgtgtaaatacacacaggcttccatggattcagtcttgtactactgccaaaagcattggtacagtagcttgctcaccggagcacaaaacaaaggacatttgcataacagcaaagttcatctgctgaaattattacttggatctatgttgtgtgttctctctcccccaccaaaagcaaacactaggtgatgctaaacagtgtaaattgttggagaaatttaatttaacctacaaattaaaagctatttttaaaagtctttgttagttttaatatgaagctggtcaaagcaacacacatttttgatataaatatgtgtatagaattccattcattaaacactaatgggaaattaattttaagtacacgatatacgatgtttattgtatgaactgagcaatgtaaagaattgctcttgattcaaaataaaaacaaaaccaaaaacaaaacccaagcatagagttaataatcattccagaaatgactttttttttcaatcttgggggagttttgtaaaactttggtagcagtaccaatcactatgatgcaacaaaacaaacacagtctctttacaaaggcaacactacataatggacattgttctggattatttcgaataaaaatcttataactaggcgttactgattgtggccgatctgaaaaagagtaagtattttcaggccgggtgcggtggctcacgcctgtaatcccagtactttgggaggccgaggcaggcagatcatgaggtcaggagatcgagaccatcctggccaacacagtgaaaccccgtctctactaaaaatacaaaaaattagccaggcttggtggcgggcacctatagtcccagctactcgggaggctgaggcaggagaatggcgtgaacctgggaggcggagcttgcagtgagccgagattatgccactgcactccagcctgggcgacagagcgagactccatctcaaaagaaaaaaaaaataagtattttcagaggaggaactcagtgtacaattctgcttgattcagcatatataaacaataattaaaagtatcagcttgcctggctttttcttcacatttttaccctcttttgattttgtaatatcatccatgaattaaacaatatacatggcttgtcagcctgctagagaagtttagattagcgtggctagaaagctgaatctcataggcactcacctgaggccacaaggcattggtaaccccaagtcaggaatctcaatgtctctaagaaggtgtctgaaatatatgaacatggtacactagtaatattctaaaaattcacactttttattctcatcttataactaggaaataaaaagttatcaatagaatcagcaggaatattcaactgagtctagtatttaatgctatatactatttaaagagtattaagataacatatctgtccttcagtattattggctcacatgttcagaacgatcttaagactttaccgaagtggacgttctcgtgatatagcttagctggtaaacagaggtatatgacagctaaacaacgacttctctttgtaaaatatgagatttaaaagtccaaattgcaaatagaaaatattttatatgaaataacagaaggatagtcattaatgcattggttaagaaattaattcaactatttatcatagagggttgttccaggtattaggatggatgaaggaaattgacagtaatattaacagcagtaacaataataatttcagttctattgacatttacggaacatcagtacatgagtgaacatctttgtaagtgcctcttttaggcagtagggacacagaagagatcaagatgaagtccctaggctcatggcgattacattttagacagaatgcaaacaaataactatgtaatatacctggaagtaataaggacttgggggagaagaacaaattgagtgtagagaaatatggaatgccagctgatagggtgggggataatacaaggagcagagttggtatttcaccttagtgttactcattttgtgcaatgtggtttttttctccatacaatgccacctgtaagaattacagtccaatagggaaatcaagagagacaacacatacttaggctaactagaaaataaatgcaatgtaacatattagtaagtactaaaagaggtgatatgacttggtataaatatgagccttgagaaaggcaaattggagagcacagcagcatagatgaaataatatgcttaaaatcttatttgattacaagaaaaataaatatataatgtcaaagagttgtgtcacctgaataagtgaaagccatgcacttttatttaatatttaatcacctaagaaaatgtatttcattttataaggttggtaaaaatgctctaccaagacctaaaacagttcaatgaaactatagactaatttcatttatgagtacagattcaaaatttctaaataaaagattaccaaattgaattaagcagtatattaaaagaatgatatacaaggacaaattgatttcattttaaaaatgtaaggatggttcaacatcaaaaaatctatcaacatatgtcttacatcaaccaattaaagtagaaagcccatatggtttttttttatcaatagatgcagaaaaaaaggcatacaattaagaagttatttctaacaaaaagtcaaagtaaaatcagattaggaagaaggtacttaaatgggataaagtcaatgtataaactgctgtactgaagccttgaattgaggattgataagaaataacatgtataaataactaagttgcatgactatgatgcaccaaaaaaaagaaaaaaaaaacttcttttatgataacatcatgagcctgtaaaccttgatgcccctgtccactttttcacaggtgaagcagaataaaatagagtaatcctgcagctgtcagctcctcttatacagtagggtcctcactcagctcagacaggtgaagccaccagccttggcaggtgcgccacaaggaacagtgtcacccagaccacaaacatgtgtagcttccttccctctgctatgtacacttagggtcactcatttatgggtttgataataaagcaaagtaaaagaagttgagtcttaatcatcatcctcattgacttttaaagatgggccaatgtttgatgtctacttaaaataaaccacagacaaaaagtataaaacagaggaaataaaataataatgaaaatatattcactgagttcatgttatgttctagaaattgctttcatttaattcttactacaactgtgtcagatagatgctattgtcattcccattttacagacaggaaaactgagaatgagggattaagtaatctgcataagattacataaggagtaagagttggaattcacacccaggcaatagggttctggagcctatgttcttctctacttctttacactgcaacaaatggaaaaaaagtgcaatcttcctggatggaaggacttaactccataacaagacaatccttccaaagtcaacatataaactgaacatcattcaaatcagaatgccgatgttttttgtttgttttatttcaaactggataaaataattttttattttttattttactttaagttctgggatacatgtacagaacgtgcaggtttcttacataggtatacatgtgccatggtgatttgttgcacctatcaaaccctcatctaggttttaagccctgcatgcattagttatttgtcctaatgctctccctcccgttaccctccaccccttgacaggccccagtgtgtgatgttcccctccctgtgtccatgtgttctcattgttcaactcccacttacgagtgggaacatgtggtgtttggaacatgaggtgtttggttttctgttcctgtgttagtttactgagaatgatggcttcaaggatgaagctggataaaatgattttgaagtataaatagaagactaaatgattgaaaatattatagaaaattgtggaagaataatgaggtggtactttctgtagtatgtaaacttactttaaagccattgagttataataatatggtattggcatgaaaaagacaaatggtcattggaaccaactagagagtttaggtatagataacgagtatttgttgaaatgacttattgtaggtagaatctgcattttatttcattggtaaagaatggtttgctttaaaaaatgataccagcccgaccaactatcaatgtgtacggaaaaaacagatccctttatcatatcatattataaataaattcccataaattaaaaatgttaatgttaaaaaagtaaaaatcttagaaaaaaaggagaatttcatgtaatctaaatgtaggggagcactttctaaagaaaaaaagaaactcagtagcttaaaaaaaaaagatagctatatgtagctagaaacaatctgattgattttctaaggcataaacttcccccccacccaccaaaaaaagttaacatccaaaagatagatctggaaagtacatctgtaacacatactacagacaaatcaatttcaccttaatatgcataggccttctaataatttataatacaagatactttaatagaaaataatttaggtaagaggatatattaggttggtgcaaaagtaattacggtttttaccattaaaaataatgacaaaaaccacaattaatttttcattcatacctcacataaagtcaagggagtgaaaattaattaaagaaacaagtaatattagcaaaaacgaatatcagtaatttcaagagtttgtggaggcacagatcacggataatttcattgtttatgataaagtgaatttccccaactttttaagaaagtagtatatcaataatgattaaaattaaacatgcattttccttttggcatggcaatacttggtaatctttccaatatgaaataaacacaagagcacatattgcatacattttcaaattttatttttagcataaaataatgtcagtaggattaacaaataatttgttttcaaccatgaaaggaatattatgcaaccataaaaaataatagggtgtgtccataatcaattaagtctgaaaagcaagttccagcataagtggtagagaactttttttctgtgaaaagtttttaaaaaataaaagagaaagagagagagacctaggatatgcaggagtatatttgctttgcttgtacgagcatacaaaaagtatggaagaataaacttcagactattaagttttcacctgagtgaaataaaacagagccacaattaatgtttcttgtatttatatatttgtactctttctctgtctgattgaaaaaatacaaatagaatatttgaaattaaaaattaagattaatatttttaaaggaaaggaagacattgtgaaagacaactttatttcaacaaatatttattgcacatcttgttctgtatgaatttttcaggggagtccatcataagaggaattactacactgtacggagtcaaatattcccacatgatctttctttatggtacatttttatcttctattgacaaaatactcttagaattatgcaatcttatgtctacacacgatggcaaggattgtctcatcacattagacatgagggttccgaggcctggagatgttaaatgttttgcctaaagccacaccgctttgagacatttatcatctcttagtccattcttaacccatatatcaatctttataaatgctcttattcatgaagttcttcaaaatagtttgatggagttaaagaagtgaggaagttgcttactatgcttttgggtgttactcttttcaagcctgaagccaatcaactaacctgcatgtctaagtttctgcttaaaatggggaactttgaaggtgccatgattctttttagagagacttttcagggatgtaaaagagctgctgaaagtcaatcgttccttaaacacttaaccggcaatttagccgtcctattttctgaagacttacaataaacagaaaaaatggaaacctgaatcattaagaaccactcaaataaaagaagtcattgtgataggaaagccatctctgaaataaacattttatttccagtgcaaaactataattctatttaaaagttttaatgtaatattattgttttaaagaacacatttcttgcttattcaggccaataacatgttcttttgtctgaatttttagggatgcaacaatatttcataatctttcttatgtacaatggatatacaaaaggtcataggaaattaaacaaactgaaagttttaatctcatatattttgaccacatatacaataataaatgtggtcttaagcatagaaaagaatagaatacaatatttagttaactggctccttaaaattcttggacatgggcagggcgtggtggctcatgcccgtaatcccagtattttgggaggcaaaggcaggtggatcacctgaggtcaggagttcgagaccagcctggccaacatggcagaacccctctctactaaaactacaaaaattagccgggtgtggtagcacacgcgtatactcctagccactcagggggctgaagcaggagaatcgctcgaacccagaaggcagaggttgcagtgggctgaaatcgcaccgctgcactccaggctgggtgacagagtgagacgctgtcttaaaaaaaaagaaaaaacttgaacacattgattaattgattgattgattgattgagatggagtttcactcttgttgcccaggctggagttcaatggtgcaatctctgctcagtgcagcctccgcctccctggttcaagcaactctcctgcctcagcctcccaggtagctgggattacaggcacctgctaccacacccaggtgatttttggtatttttataccttatacaaacattaattcaagatggattaaagacttaaatgttagacctataaccataaaaaccctagaagaaaacctaggcaataccattcaggacataggcatgggcaaggactaagtattaatggtttaaagtgttgccaagctctgacctgaactctcaaagtattctggtctaagaggcaagaaagccgtattcttcagattagtcaggttgaatttagctgtgatagctcttctttttttcatttctgttacaaataccaggaagctctctgagtttgaccttgactcattttccgggtccacagacagcattgcacctccaaaacaaatagcgtcctatatctgtgctacaacctttgctagttttagggtgtttttaaaaatattccccacatccaggcaaatcctctatgtttataaggaacacatctaaaacttctcttcatcccagcctctcttcttagaactctccaaaaagtttttttaagattcacaatgatttcatcccctgtagtataatttggtagatattggcccattgttaattataaattaccaaagtaatcatcaagcaattgtccaactagcatgtggtgagagcccttttgtcaccaattattagtaagaatactctttaaaaaatctcaggtcatagtcttcctggatgaaaccttctccctttgatttaagatagaaaattatggtcagtccttctccattttaatttctatattgctcctctttggtttgcataggggtacaaatgtacatataaatatgtcaccttgtagaaacctgtctcttaaagtttcaaaataactgtatgctagggaaaaaaatataatctaacaaaacatgactctaattactaactgaactccacctctgtgcacatggtactaagtgaatgtagagtttatccctgctatgaagaagcttacaggctgggacatgagatatatatcctggcatttatataaagagcactagaaggtaccaataaaagagatgaaagaggataacatgtaaataaatgatttttgtcatggcctgtgcacattttttaggatctctttccccataagaacatgagtgtgttaccactatgctcctgtagagtttagccagaaaagaaaataaacttcagacattctagaattctactacaaaatgttgttctttcttctgatgctcaagtccacatgttagctaagcacaaacatctttggcttccctttttcaaagctttctatacattccttatccctgagaagaggatgtgctattaatgctttaattgctaagttatatataaataagattcaggaactcaattttgcatcttcggaaaatatgaataatgatttctctttcccttcctccaagaaaaagtgacttatttggcagtcacactaacagtgcaaagaaatgagttctgatgtttcatttagttgagttataaacatgaaaaccatcaaatcctatgcaaccctattgaagcatgtggatgtgtgaattttctccatgtgtttgctctgtgtccttcagaacacccacagtggcgatgaatcgctaaggtgtgtatcagtctgacagtcgtagaaagtggcaagactgaaagccaaacccaggaaacagcatttcatttagctcctggagtactgctaattgatctcaaacccttcattactgtctagtccaaaggcctcaggagaatgtagccatttagaaaatgacttaactgaaaacaagagcaaaattctaggcctcgtgaacttcaattgctctattcctgtatcgtcacactgattctaagtttatctttcatttcaggtcacttggaaacccccactcatccagaacggagacatacttagctatgagattcacatgcctgaccctcacatcactttaaccaatgtgacttccgcagtgttaagtcaaaaagttactcatctgattcctttcactaattattctgtcaccattgttgcttgctcagggggtaatgggtaccttggagggtgcacagagagtttacctacctatgttaccactcaccccaccgtacctcagaatgttggcccattgtctgtgattccactaagtgaatcatatgttgtgatttcttggcaaccaccatccaagccaaatggacctaatttgaggtaagagaaggtgactatgatttttatgttgctgtagtccttatctctctgagaagtagggaaatgaaggaggcttttattcctatatgaacatagaactaatttggcattgaatatcccctgactcataactttcatacactatcatactgtacacttcaacttattatggaaacatcaaagtttatcaatttgaagaactaaaaacccttgaaaccacaatcactattgtctaaggattcgctacataatccatcacttcattttcaacatatgcttttattatatgttaggcaaacctgatgtaggttctatatgatacatttgcacaaatgtacctcagaattctaaggctaacacagtaattctttggcatgttgttagcttatggaaacttgtgaggagtgtggtcagggagcccgatacgatgaaagaaaagagctgtgattcagaaatggttttgcaaccacccaaacttgatacttggccaagaatacaaagttgataatattatcatcgtttataaagtattgatagtcataggaaaccattaacttgataagctttgtgtatttctactttgtgcgaaactggcagtaaagatttggcacatctaacttagaagaaatctaaaatgctatcattctgggagataatagtaaaatgcgaatgtaactgattcttcaaaatattaaatatatggaatttggtccagaaaaaaaaacgttcatctgaaacaaaaccacgtaactgtaaacttaagatgttattctttatgcttccacgcatatatcacacgcacatgccacagaacagcctgagttttggtaatctcaatatgagttgagataatcctgatgttcctgcttgtcttttgctttagatatgagcttctgagacgtaaaatccagcagccacttgcatcaaatcccccagaagatttaaatcggtggcacaatatttattcaggaactcagtggctttatgaagataagggtcttagcaggtgagattacaaaaactataaaaacaaatgctggcatttagttctgggcatgttgaatagttcaaagtatctcagtgtcttcattgtgtgagcgtgttatcagttatgcaataaaacatgtttggttattatctgtggcattaatcacccagctgtaacagtcagcatgtttaatgttttccatcttaactgcatgcttaaaataagccttttgaagttgaacttgtagatgttcaagccttaacctattgcctttgtcacggctccatctagacataaaacgttatggaagaatttggaaatattgaacacatacaaaatggggaaaattcctgggcacttgtagaatgcttgctatttctagaaatggcttataaatgaattataatgacttataattgattgtaagttattgattcagtccgcaaaagaaaacattagtgaacaggattgggacttgaaagaattcaatctagagttcaaagacattcagtaaaggctaataggtgacagtagaaaagggtgctacatgggagagttaggagatctggttctgctttagcctgtgctggagaactagctttgtgactttaggccacaaagcttcactacttaaaaatcacttaacttctctgggcttcatttttgttgtccataaaatgaggtgattttatagaattaaatgacttctaaatcttcatgagttcaagcaatgtgattaaatttcagaaaacatgaacgttattttatgaaaactcctcgatcatatgtttcagtaacttttctatgtgggtcattatttttctagacccaccactgggtagctgtagtctgaaccctgtttaccattctagccttgtctcccatccctttcttaccaaggcctctgcattccagccacatttgtattgcattcagtacctccaacatacaacacttgctctttcagcttttccccatagttgccttttcctgttgcctgactagatcatctgccacgtcttagcctggaggtttcttcctctaggaggcctttcctgccaacactcttgctggtctgattcagctcctctgtaacatttccataggacatcccctaacatatcactattgtcattgtagtgtactggcctgactgcttgtctaaacaccacgttatattatcagatctaccataaggcaggggtgcggtcttcgtgactctgtcttcagttcctagcatggtgtctggcacataccagcacatagtgccctacacctgaatacttaaaaataggttagctcaatcaagaattaattcactgctctgtaccttaggaatattagctgtagtgttcttctctctggggaatggcaaaactaaggaaaattctcctgtcctcttaaaaagttgtggtgggaaaacatcctagttcttgtaagattctcagagagaggcatctcgtaaatctgatcaagcaacagaatgaactatatgaaactgccacttttataggtgaagattggtcaattactagcagatccatgttgcttatcctaaattataatgctcattatactattctcaactacttttaattcattatttacttaatttggcatccctatatgattatcacttcagtagaataaattcatttatttttgcttatttgtgcttactgtgtgctgaggcactgtgataaggaacaaaagataaatacatcttagcccttgacctcaaagaacttataatctagtggaggaacccttccccccgccccctccatagagagtgtgatataatatgtatttttatatattatatacattattaattatatataataatcaatatatattatatatttatatattgattattatatataattaataatatatataattaatatatatattaattgctgtcctcagagttatctacaaagtcaccaattctgcctaaagaaatcacttcaaatagtagcttcctgtgacctatgaactcttaagtgcttaaatataactatttcaaaaaataaatagaacttgactctttaacattactgaatctgagttttagccatgagctactcagcaaaaacaaagaataagtttccaaaagttaattttgtttctttatacaagaaatgaaaacttattaaataattaggaccaaggccatgaagttagttatgaatttttagtgattcctctaaggattcttaatgagaagttcaaatctaagatttcaggaaaaaataaagtgaatttccacaacttaaattgaaacatgaattgacataaacacacccatgacagctgcttccggaagggaagtgtgcagataacaaaattgtgttaaagggatattttgactagtttcataatgccaaatgtcatttttttccggtagtacttgcacagattttttttatttattaaaataacagctacaacttacattaagcttgtagaaaaaaaaaaagcatttcttcttaacattcagtgtaaatggcgtgagtctttataagaatctctttttctagccctctaccctttataagtccataaaaagctaggagtgcctttagcccaagggggagtgtcttgcaaatatgagagaaaaccaaaacttgatcccctggcgggcaggatatttttctctttaaaggaagtgattttgtttggttagatggtgccactggccaccttggcaacatccggggctccttgttcctgctggtcagctagtggtctgtcaaattgcagagggggatgaagctgagtgttcatcatgtgttggttcacccctgtgttactgttccttcatggcccttcctttgcctatatttgttttgctgatttatttgtttggccaggtatgttttcctgggtttttaattgaattctaatatctttgggaggattatgtaatttcctattctccccagattccaccatcccaatttccttcttaacttaacgtctgcataaataaaaggagcactgaagtgtttcttaccatcttgacttgaatatcaccatagttacatttagaatcagcttttaaatggcacttctcctgatataaaaagtaaaattaagattcactagacatctctttatgaatatatttgtgacagtaaatataagttgaagccaatttcctagttcaagtggtctattttggctaagtatgtgtttataacgcatagaaaagcaccaatttaatttaaaacatcattatatttggaacttcagatcattctagtagttattttttcttttatatctacatgtacaaaacagtctcaagtcaattatccagataatttaattctaacaaaaatactttttgctcttatgattatcttaggtaaggagtaatttttgtctaaattgcacagctagttgcctcattatcgaattttgctctgcctgtgtagacacgaattccgtataactacaggtttatactgcttgtcagtttctaacttttcttccttaataattccttgcaaagtgagcaagttatggttgttgggggaactataactttgggtttcctgacattttcatcacttagaaaatctggcgaacgtgctgttatcatctgaagctgccgaagtgagtcaggcagggtttaacaagagggcggcgacctccttcattttaagcatcaatctaccttcacaattttcagcacctaacaacactgccttggttcctaagtgatcagataaaactgctaagaatacaatgagcatgttctccttttcgttgtggatttaaagaagaacaagttataataaacaatagggttattttactattatagagaaaatattgactgtcagattataatttagatttataaattagctttcattaagtttatgaaggaatgtatgttctaattgctattccttttaattatttatacatttctcagagtatttttttttttttttgcaatgacaatttggatggagacctctatgtgattcctcgagaatccactaattgtattacatttaaattaaaacattcaaaattaacacattttcgtcttatttttcaaagaagggtaagacttaagatgtaaatgcttaagctaaatatatcataaattctaagtttaaatcttattgacatatattttcatatatatttttaaatctactaaaataaagatgtttcaagtcctaaaagaggatgccatttctgtgggggataatattcaaaagaacataacttttgttcctcttctttgtaatgagattaaatatgtatagatgacatctgcatctttgctagtatgaaagactgggtcagttccatgacacgtgtttctataatataaataatgtcagattgtagctattaagtgaagaagttaactttgtacatagaaagggcaagtgaaaggaaagcttctcccgtgactaccaagatgagatagatcctgttaatttattccttaatatgggaatgtgaataaaaattgagtctaagaatgaaagccaacttctgtcaacactagtatgccatctcatagccatgcacttaattcaaaaggagtaaacatgtctttcacattcaaattaaattggtcacagtgttttttcccattggatttttttttcaatgccttacatgccctacacgatgtccttttctgtgtcatcatattatgtgttacctccttgtattagcccattttgcaatgctctaaagaaacacctgagactggataatttataaagaaaagtttacttggctcatggttctgcaggctgtacaagaagcctggtgccagcgtcttcctctggtgaaggcttcagggagcttttacccgtggtggaaggtgaaaagggagcaggtatgtcacatggcaagagagggagcaagagggcgctgggaggaatgccatgctcttaaacaaccagctctcccctgagctaatattgtgagggctcactcactaccacagggatgacagcaagccattcataagggattcacccctatgatccaagcacatcccattagggcctacattcaacattggtgatcacatttcaacataagatttggaggggacaaatatccaaactatatcactcatgaaaaatgaacttctaaatccagaaggatgtgttttgtcacaggaggtttttttcccctagtgttttcttagaataaaaaagcagaaaaactactttcattggctgtatttctttctcatggtgatgacaaagtagaacaaagatggaaattactgcaaaattatcttaggtctgacaattctggtagtgtagatatagatagcaacagaaacataacagcttcaagtttcactcacaatctaaaatgtctcatattaaaaatattcaagtgtgatcaacattactcttcaatttttgaagcaaaaatcttcaatactatttttagaatcaacaaatagattttttaaagtgtctaccatcagctgaaaattttaatagctatagacttaagcaatggaaacaatattgcatttcatttttctttgtttgctattcccacaaaagatttgaagatgtaaggaaaagtatgatttatgagatttctcaaatccacacttgtgtgatggtgtactgaaaaatactttgggttgtggcagagatgaggaagagttagtggaagaagcaactaaataacctgcattttcagaagcgtgatttatattggtgacaatattaacacatgaattctgttaggacatcaataaagttgacacatttttaattctgatgaaaataaccccaggcattctgcagctgccctgaagaattttggtttcccacaatatatcagtcccttccaagatacaagccttcacatattttgccctggacaaatgtcttcactggataaaataccacttcttatcaaaacctgccccaaatgttacctcctccgtgaagacttcccagctggatatggttaaattagatgcttcatctgatgcgtgttcaaagaataaggaataaatgaataaattagatgttctcatttaaaaacatatttctgtaaaattttatatacattatggctccaggtggacagataacaattttattatttttaacacctggcatattggtaatatccaataaatattaaatgaatgaacaaatgaatgagtgaagtgatgtattaaatatgaaaaagcaatataatttgttttcaatatatttttaaaagcactttgctaagtttcagcagagatattctttctattggacaggtagatttttatctcactaacctaaaaaattatataagtgacctgaaatttttgagactgagtgcttaaataactatgaaacatctattcattcatttataaaattatctattcagtaaataaacaaattaaaactgcatcatttaaacataatctagttttctaattcattggagtaataacacctgaaccttgaaatgaatattgttccacaagtaagattttaacacatattattttttatgaggaaaattaccatagtcatgtctataccataataaagtttacaatttgctgtttggggagtggaggagggagagaccggaggatggtctcaagcaaatgggggaaaaactattgtaatagtccaagtattcctaaatggacccaaaaacaattggttttactggctacatcatagactcaatataagtattcacttactttgaatacttatattgcaaaagttttttcctacagagtttaaaatggacatttttcaagacatgcctagagaacacactttgtatttagagaagaaattgattgatacacataagttttgtcataagtatatgatgttaattgatctagcatttttgttttaaaatgtattcttttatcatttattaaatggaatgtcccatttaatatcaacaatcaacacgtaagtccatttgaaaaacagtatacatagagtgaatggaaaaccacttcaagccaactaatacattctttttttgatatgaagtggtgaaatgtgaatcaacatatatatgtagacaagccataggtatatattcttactaaatacagattggaattcagatgaaatgaaaacagtatattttagtatttaagaggattcaggatcttgtttcctcggccaggcgcggtgactcacgcctgtacagaatcccagcagtgggaggccgaggtgggtggatcatgaggtcagaagatcgagaccatcctggctaacacgatgaaaccccgtctctactaaaaaaaaaaaaaaaaaagctaggagtggtggctgacacctgtagtcccagttactctcaaggctgaggcaggagaatggcgtgaacccgggaggcggagtttgcagtgagctgagatcgcgccactgcactccagcctgggcacagagcgagactccgtctcaaaaaaataaataaataaaaaaaaaataaaaaataaaaaaaaaatcttgtttccttaaaaatttaacttaacaatgaaagttaaagtacaaaagacaaatgtacggcctcaaatgaaatatctactgatttctcaattaaatttttaaaaagtggaaatagtgtaatattggaaatgaataaaccctatgtccagctaccccattaactagttgtgcaaacttacacaaatccacttgtttctcagggtctcagggttttttgtttaatctgtatgatgtagcacacactttattatttgtagcagataaactctaaagccatctcttactctaaaattttagaaccaccttgaaaacaggcatgcaattgtgtgtatctatgtggcctgagttttgtagacgtaaattgtgtatttcgccataactaaattattgtgaaatctcttaaagtattataaaaactaaagccctatagaatttatttacaatcaaccattttagcgccacctgatattgttaattccacatgtaggaaagaaccacaaacatggtatcactttaaatccataaagattattaattgtataatagcatagacatgtggaagaaaaatttacatattataggagaggaggctaggtatccagactctagctacatttcttttaagtcattttatgaagtaaaatataattataagtattttacccagggagagagctaatgaagccaaggtcgctggttcaattcccttgtgagccattagcttcatttcattccattgtcataggcttgctaccctcttaaccccgactcatcatccttcatattcatactattggttgcaaaggaaatttggccagactgtttgaatgtgtaagcaaaaatctattccctctgctagaaaaataacgcaaagttcaagccttagtgatatgacatcatccaagtatggacagaacagattatcattatgattgttattattactattattattatcatcactattatgttggcagtatagcatcatggttaaaagagcaggctctgaaatcagactgcctatatttgaatctcagtcctcctacttattatctcaatgacttggacaagttatttatctctctgagccttgtttttcttattttcaaaataggtattataatagcaccttatagagttttgtgaggaatgaatgggttaacatctgtagaaaatgcctgacagctattaagtaactattattattttttagttgtctggattatgtggactattcagcacttgctaaaaagcatatgtattcattttccagggctgcagtaacaaaatatcacatactgggtggcttgaaacaacagaaatttattctctcacaggtctggatataagaagttgcaaaccagtttgtattctggaccagactcccttccaaagctctgtagaagaaccctttcttgcctcttccaacttctggtagccctaggaaatccttggcttgtgacagcataactccaatttctgtttctgtttttacatggccatcacctccctgtgtgtatccatgtgtctataaaatttctctctcttttttcttccaaagacatcagcattgaatttatggtgctgcctaatccagtatgacctcatcttaacttgattacatctgcaaaaaccctatcttccaataaggtcgtgttcacagggaccaggggcttgggcttgaaaatatctttttgaaagatacagttcaacccactacagcagacaaagcagaaataaaagaggcattaaacacctgagaagagatggtaaagcagggaggtgtagaagatctgatgcaagcacatatttaggagaaatagataaatagcctcaaaaagtcactaagttttacctgtaattacaatagagcaacacctttcaatgtgggtcaggcagaaacctgcaaacgtatcttcgggctatgaataagaaacaggatgagtcaagcagatttcttctacctaggtggcagtaaaatgctctgaggatcctgatataattttggtcaaattatttaacacaatcctgcaaatggcacctacccacccatgccacaccacctttgcatcgtcaaatcagagattgtgacatattgagacaaatactgtgggccttacactggagatgaggtatccttgatcatctaataaacccaaattaggtaatgatctgaggccagtgtttgccctgtgtcctggatgcctctgggatggtcgtgtgttgcactacatgtttaagcaagtatctcagtctaagctattgtccactcatagactgactgtgtctgtttatggcatttccttacacaggtagttctgaaccaagcaaaggaagcctgatggtcttctgcccaaaactggttaaaaaaaaatggtggctttactctatagtcaatttaataaatgacttggaaagtcctcctcatatcacatcagcatgtcagtttttgccttctgcaaagtaatattcggtttccactgtattgactcaagtaaatatgttcacactatggcaaaatacagctcactgtagcaaaactctcagcgggagaatgttgtacactttggtcacagttacaatttaatttaggggtttatctgtctgcagtgagattatgggaaagaagcataggtatcggaagaaaatgttgatgagggattctgatatttgaaaatggatgagtttccaaaaagaagagcataaaactctctggatcaaattcagatagaaagctggcaggttgcctgatttgtaattgcatcttgaattgagctgtaatcctcaccacttctgaaaacaataagaataagaaaatgataaaccacatttgttttcaatagcaatatttgttcagcattcctaataaaatatttccctgatgttttggtttatgctggcaagtcacaaaattaatgatatgtgttgtgtaaggagggaaaataaaataatgtattttctagggaggaaaagaaaacagtattttgtagaggggtggaaggaaatcctgtattttgtgaagaaaaaaagaaattatttgttagattttctgtaaagtagaaattcatatactttttttaacaaaacaacattttaggtttacaacctatgaatatatgctcttcgtacacaacagtgtgggttttacaccgagccgagaagtgactgtgacaacgttagctggtcttccagagagaggagccaatctcactgcgagtgtccttaaccacacagccatcgacgtgaggtgggctaaaccaagtaagtaagcttctcatacctgtgttaacactttgtgtatttttaaaagcatattctttctttactatgaacctcccccatgtacacatcattttgatagtgaagtgttactggtaaatttttaccaattgcagattgacagggctgtcattgaaaactttagaagggccatttttattagtacccaaataaattagaaatggacacattaaaactaaaaccctggggcccctgtgccattcttaagatgcaaactctctcctactttgacattgttcttgggcctcctgctctccctctgtcatttcctttgcatgaacaacgtaatttctatcataccaggcaattgtgatagacatgtccatgtattaattggatacaatgtactattgttcaccttccttcagagagctctgccctaatatcttgtaactcgtcgctcattagcaagaaccatttaattggattgcaataatggaacagattcttcccagtggatcatcttcagactggctatgggcagaattccagcttgatccagtaaaaggaagcctagacatcaccactggatccacttaaataatgcagggtcgaccctggacctgctgggaacacttttttaacaggcatttggaagagttcacagagtaatctaatctgttcctgcaacgttagaaaccacagtaactgaaatttcacagttacttggtcagtagggtagtattaacatgttaatttgttgtgatctgttaatttgtgtcaatccctgacgactatcaggaaaaaaaccctgaatctaccatgagaatatgtattaaaatcagtcttataggtataacttgagatctggcaaatagtttcatcaaaacttgtcagaataacaccaaatattgagaaatacctgatcaggaaagacccactcaaaacattttatttatgaaagaacactctgctcactggggtaatcatctattgatgatataaaaagatgaaaagtcactactggttgggcaatgtaaccatgtgattttggttacactggatcagccttgaatttggttacagcttaagaagagagatgctccatttaggacacctgagtgatatcaattgtgaattaaagccagaattgaggatatcaattgtgaattaaagccagaattgaggatatcaattataaattaaatcagtaggttaggtttatctgtgtttccacaaaataatccatctttacaaaagaaaactgtctttctctggtttttataaggctgcaggtttctaatgatctgtgacacttgtattgggatctcttaaaccattttaatggaataatataagttaattgatgcttatggctaccctctgaaacacctctgggaaaaatacaaagtttttatctggggatgtgttttaaggcatatttccattcatctccctcttgctctctactccacctcactaactgattcatcttaaaagcctactcataaaggtaggctctcccccctcatctgacatttgaatacttctgttaagatccggctggtgaatttccaccaatataggtcctttatgttataattgcattcctgaagtaactgtgcttataaaaactgacaaacctaatagatctgaagcagctcactgaagtttcattaccttggtaatctgaacctctgaccttcgggatgtaggtaatgcaatctgctgttatttccattcataccttggaaatttttcagataactatttgtgagcacaaaggttaactctcagaagagggtcagtcttgcgaaagcttgttgcattatcattttcttcttttgggcaacttgctatcttaagtaaattaactagtcgatcctctgtgaaaggtggcctattttttgcaattttaattttaaattgttgtcttgattggataggaaaaacatggcatacagtctaatatgctcaaaggcaacaaactatagattgaaaatactttgcagtggaaaatcatgttttaaatttataaatatttgcttattaaaaatcaccttccaatgtatatatatatattttaaagcatggtctttgtctattatgaccctccccatgtacacatcattttggtagcaaaatgtttctggtaaatttttatcaatcacagattgatatgtataagttattaaaaacttttgaagggccagttttaaacattagtatcacatacatgatatgtgagataaaagcgtccctgtgttacttcagttcatttttggaaggcagatgttgcaaattggcaacacagtggccatatttccttcctcctccagcttccatacactgttttgcccacagtatttgaaaaaataatatttgcaaacatttaagaattatacataaagataatttgaggattcacttgacaagtcaaatgatggggtgaaacaatacccacatttctggaaggaaactatcagctggaactggcttcccctttagacagatcatgccctaaaaatctgacccggtccccattttcctggtcccaatagacaggtgatgtttatccctgctttatatgataatacaaaatattttgccctaaacaaaatacaccaaagataaattatattgtaattttgaaaaatcacagtttttgtatttgaaaaatacctcacttaaattatttatacaatcctcagaaaagcacaatgagatagaaaccagcccatagtaacttaccaaaaattatagaaagtaccagttcccaaactcaaacttaggactcaggcatcaaattttctatttctcatgcgtttagacttaacagtcattaacactttaacaagaaggatttaaaaggatccttctcatcttgactgctcagtctaaaatagaaggcaaaataagaaaatgcctaccaaagggagtacagtggagagatagtgcctcctttgaagctgattcactaaggaagtcagttgtggccagaaaagagcagtaaaacactggagggagtgagagggcaatgctttgtaaaagaggaaatgaaaaatcatcaaaatattgtctactttactgtctgtcaagagctcaccccaaccttcagatgttcatatcttgtatcatataatcctcctggtcttgctctctccttcctctttttttccatcttccttctttctctatttccttttttaaaatgtttttgtagagacaggttctccctatgcttaggttagtctcgaattaatgggctcaagtgatcctctctccttggcctcctaaagtgctggaattacagccataagggaccatgcctggccatttgtctatttctcttcttctaccctctctctctctctctctttcttcctattttccttccttcctcacagatacatttatcactttctctgtcctgagcactcagtgaactctggaaaatgcataaagtatgagggtatcatcattaagagggcaagtttaaaaccacagaaaaagcatttgtctcatcctgatctcttaatcagaaactaccaggtttgatagctagaagtatatctgactttgcctgaatttatctgattaaggtggcaatatctgtaaataattccaaatctcatctcttctaaaaagcacctaccattgttgcctcaccttgttcctctgttctcttttccatcactttagttatcaaatagaagagaccacatctgacttttccattgtcttccttctcagtcacttgtgcacctgttgtaatctgtctctcttcacttgtactctacatggttttcttaaagtcattagttatcacctaatgacccatttcaaaactctcttctcaatgccatcctactgtgttcctcttgtatccagcactgtgaatgatcccttactgactataattcttccccaataatcattactcccctcttctcaccaactacttcttctcatccctaaagatgtttctcaaagttctttcctgagtcttcctatcatactcctgttctcttgttggtgattccatctatactcaaggtttcaaattcttctaattacaaaaatgacaaccgccaacattgtatgcagccatatgaataaatagttttaaaatagactttgggatcagggatacttaaatttgaatcccagttccaatatgttttggcactacgacctagaatttaacctgagttccagttttctaatcagaaatatgaagataataactgccctgaaatctgttaaggactaaatgaaataatatatgtttaacaattagtaatcacctagtatttgtaatacagagtattattctatttctaaaatgtgcatggtcctttcaataccattttatataatatataaaaggggaagccatgtctagtaaaagcttggaagttgattttgcaagactattcagataaaagcattttttttattattattatactttaagttctagggtacatctgcacaacgtgcaggtttgttacatatgtaaacatgtgccatgttggtgtgctgcacccattaactcgtcatttacattaggtatatctcctaatgctatccctccccactccccccaccccacgacaggccccggtgtgtgatgttccccttcctgtgtcctagtgttctcattgttcaattcccaactatgagtgagaacatgcggtgtttggttttttgtccttgctatagtttgctgagaatgatggtttccagcttcatccatgtccctacaaaggagataaaagcatttctacagtgagttgaagatgcataaagaatatatgttattttataattacctgacttggctaaaagatagaaatttaaaaatctagttaaaatgttgaaaacttagtctgggttccatggctcatgcctgtaatcccagcactttgggaggccgaggtgggcggataatgaggtcaggagatcgagaccatcctggccaacatggtgaaactccgtctctactaaaaatacaaaaattggccaggtgtggtggtgcatgcctgtagtcccagctagtcgggagactgaggcaggagactcgcttgtacccgggaggcggaggttgcagtgagccgagatcgtgccactgcactccagcctggtgacagagtgagactctgtctcaaaaaaaaaaaaaaaaaaaagcgaaaactactaactattgcatggcatccattctcctctttttcttttagtgatagccttgccccttatctagaaactgcatttactaacctcccttgcaattagtcatggccaggtgaaataccagtagtatgtgtttgtgtcaatagaaagtgaaagacaatctgcatctttttgggtattaaccagaaaacactgggtgtgtgcctacttgttctcttttagcccttcccctggactggaatgaggacatgatcatgttctcaggttcaactatgcagtcgtgtacaacacccaaagagatccaaaatccccataagagaaagttcctgggttcttaagtgaccacatggagcacagtctgttttgatcactttgaagctattacatgagatacaaattaacatggattttatttaaactattatattttggagattttaggtttcaccagcttcgctaactaactcattccctgtttgcccatatcaatttaccttaaaagtagaaattagctatcctgttttttaactaaatataaaatgatgaataattaatatatctattatactatctcctttaaatacagttttctctggcaggcccctgatagaagctggaacactatgagagactaaagtagctctggagtttccaaagtgcaggtgtttggttttgacagatgggtaaactagagacaagacaggagatatgctgctcggaaaactaaggaggctgacttgaaggattattgcccaagaagttaatctttccacttcatgtcagcagtagtaccctcaggcagagtaaagaattttctcaagagcagttttgacaagctcaaattttccaagagctgcttagttggtgacgcagagccctgcaccatagaacttggaaaattggactctaatttggagattctgcgagcaagatcaagacttccatcataaaatcagcttaataaggtccttccaggtttttacatttgagcaacattacctcccaaaatgagcctgctaatgtgagatgtctgaagaatttagtcctagacaaataaattaagagatctaataaatgaaatgatttactataattgatctgaatcagtacaacaaactttttttgtaaagtgtcaaatatgtataatgttagactttgaagcccatacagtctctgtcttaactcaaatttgccactggagcacataaacagcaataaggtgattctgatttttaaataagcatggccatgttccaataaaactttattttggacattgagatttgattttcatatattaggttggcacaaaagtaattgtggttttcgccattgaagtaatggcaaaaaccacaactactttgcgccaacctaataattctcacatgtcatgaaatactttttttcttttgtttttttcccccaatcaaataaatgtacaaaccattcttagcttgcagggggtgggccacactaggccaacaggccagatttagctcatggaacatagcttgctgacctctaatgtagatgttaaaaatctagaagacataattgacattgataattgtcttggtctgtttgtgttgttataacagaatacctgaggctgggaagtcaataaggaaaagagttttgcttagctcatgattctgcagactgtacaagaagcatggctgtagtatttacttggtttctggtgagggcttttgtgatgcattaaacatgacagagaaggtcaaaaggtgagtggacatgtgcaaagatgcaaaatccaagggatgcccggctttctaaaaacccactcttgagggaactaattcatttcttcaaaaactaacccagccttgccagagcaagacaccaagccattcatgagaatctggccccatgcaacaaacacctccaactaggcctcatcttccaaaactagtacactggaggtcacatgaggtttggtggtgatataaacccttgatccccctttgctgggaaccatggcaataatttaaggccatgtaagaagcacaatctacttgctgttgcaggataacttttaactagcccgtctgttatggactaaagccctaattctcagtgtagctgtatttggagacggggcctctaaagaaatacagtcatcccttggtatatgcaggcgattggttccaggactgccccctaagtacaccaaagctgtgcatactcaagtccagcagtcagccgtgcagaatccatgtatatgaaaagttggccttctacacgagttttgcatgggagaatactactttattttttttggagatggagtctcattctgtcactcaggctggagtgcagtggtgtgatctcggctcactgcaacctccacctcctgtgttcaagcaattctcctgcctcagcctcccaagtagctgggactacaggcacatcccaccacgcctggctgattttttgtatttttagtagagacggggtttcactgtgttagccaggaaggtctcaatctcctgacttcgtgatcctcccgcctcggccttccaaagtgctgggattacaggctagagccaccatgccagctgagaatactatattttcaattcttgtttggttgaaaaaagtccctttataaatggacccaagcagttcacacctgtgttattgtgttgttcaagggtcaaccgtaattaaggttaaatgagattataagagtgggacctcgatttcataagttagcacacaggctcgcttgctctttctctctgtctctcccccaaccccttctctccctttctccgatcacagaggaaaagcatgggaaaactcagcagctagaaagtagctctccaaaagccagggaaagagccctcagcagaaactaaatttgctggcgccttgatcacgaacctctagcctccagattgtgagaaataagtttctgttgttcaagccacccagcctttaatattttgttaaggcagcccgagcaaactaatacatatctaactactgttaaaattatttaggaattcattataaaggagaggagcctgttctatatttgagaatttgctccagctaagataaaatttctgaccaaggattggaggttgcaactaaaaataacatttaatagcaaagctcttatccaaaaaggttacaacctttttcagctcactgagattgtaatagtctgttctcacattgctataaagaaatatgcaagactgagtaatttataaaggaaaaaggtttaattgacccacagttctgcatggctggaaaggcctcaggaaacttacgatcatggcagaaggtgaagagacgacatgcgagataggtgagagagagaatgcacacataggaggaactgtcaaacacttatgaaaccatcagatcttgcgagaactcactatcatgagaacagcgtgggggaaaccacccccgtaatccaatcacctcccaccaggtcctgcccttgacacatgggtattatggagattacaatttaagatgagatttgggtggggacatgggacctaaccatatcagagattaacttgatattcccacaagtagggcaatacctgctcagataaatttatgtggtccacaaaatatgcatcatacataataggattagaatatctgagaaaatatatcccaatatacacatatttaacataatctcacaggaaatcccgatttctttctattgcatcaaatacaagcaagtacaagccttaactccatattgtataactgtaactcaaacattcacattgtagtttttaagttcacctagttgccacagaaacacttgaaagataacaaaatcctaagctccaacaaccatctgagtggatccccacttggccaaggggacaccagagcaaccttgaaaactgagttcttggctacagtgggatgggaagtcagacacccctccctggctatacaccattagggttacttccctaagtgctaagcagaaaccaccctttcaaaagattccaccactgatatcaaccaaccacctgatgctgcccctcttctactaactgatgagagacctctggccacagagttgtcatggccagtgtatggagaatctgcagtcagggtcttcatgtcctcttcttcactgcttgatgtcagagggctgaaaactccaccctcagattgtgctaatgctgccatttttgtacgtgggatgcaccaggggatgtaaaactcaattgcacatgtgcgtgtttctcctttcataaatactcatgactcttcctgaggcttattgaatatgtatattcagtcaccccactcagcataaattcctgttgctcctcccttgaagaatcttttctggcttctggcttaaggctaccatatgcttcccaggctgtctgaatggccatcctgcaggctgcaaccctttatgagaagtaaagctctccttttcaaatttatgaacctcttctgttgacacacttcaaactcaagaagtctcaaatgaaacaagtttcaaaatctcatcccataattccatgttttctatcttatttaatgggattcacccagaaactaaaaccaaaaatctaagctatagctgtatctcttccttatccctttttaatttgtttatttacttatttgtacacgaataagttctttagtggtgatttttcagattttggtgcacccatcacccaagcagtatacactgtacccaatggttagtcttgtatccgttgcctcccttccacccactcccccgagtgcccaaagtccattgtatcattcttatgcctttgcatccttacagtttagctctcacttatgagtgagaacatatgatgtttggtttttcattcctgagttacttcacttagaataatggtctccagttccatcaaggtttctgcaaatgccattattttgttcctttgaatggctgatacacacacacacacacacacacacacacacacacacacacacacaccaaatttttttatccactcattgattgatgggcgtttgggctggttccatgttttcacaattgtgaactgtgctgctataaacatgcatgtgtaagtatcttttcatataatgacttcttttcctcttggtagatacccaggagtaggattgatgaatcaaatggtaaatctacttttagttctttaaggaatctccacactatttttcatagtggttgtactagtttacgttcccaccaagtgtaaaaatgtgttctttgtatcacatctatgccaaggtctattattttttggttttttgattatggccattcttgcaggagtaagatggtaccatattgtggttttcatttgcatttccctgatcattagtgatgttgagtatttttcatatgttttttggccatttgcacgtttcttggccattcttcttttgagaattgtctattaatgtctttagcccactttttgacttgattgtttgtatttttcttgctaatttgtttgagttgcttgtagattctggatattagtcctttgtcagaagtaaagatttttaagactgtctcccactctgtgggttgtctatttactctgctggttatttcttttgctgtgcagaagctttttagtttaattaagttccaactatttatctttctttttgttgcatttgcttttaggttctttgtcacaaagtctttgcctaaactaatgtctagaaggatttttccaatgttatcttctagaatttttgtggtttcaggttttagatttaagtctttgttccatcttgagttgatttttgtacaaggtgagagatgaggatctagtttcattcttctacatgtggcttgcaaattatgccagcaccatttgttgaataggttgtcctttacccactttatgtttttgtttcttttgtcaaagatcagttggctgtaaatatttggctttatttctgagttctctattttgtttcattggtctatatgcctatttttataccagtaccatactgtttttgtgactatggccttttagtatagtttgaggtcaggtgatgtgttacctccagatttgtccttttagcatagtcttgctttggctatgtgagttcttttttgattacatatgaattttaggatttttttcaagttctgtgaagaatgatggtggtattttgatgggaattgcattgatgggaattgtgttgatggtaatttgatgggaattgcattgaatttgcagattgcttttggcagtatgatcattttcacaatattgattctacccatccatgtatatgggatttgttttcatttgtgtcatctatggtttctttcagcagcattttatagttttccttatagaggtctttcacctccttggttaggtagattcctaagtattttactttttatttttgcagttattgtaaaaggggttaagttattgatttgattctcagcttggtagctctttgtgtataacagtgctactgatttgtgtacattaattttgtatcccaaaactttgctgaatttatttaacagttttagagggtttttggatgactctttagtcatccaaatgtctctagggttttctgggtacacaatcatgtcatcagaaaacagcaacagttggacttcctctttagctatttggatgccctatatttttttctcttgtctgattgctttggctaggatttacatactattgatataggagttaaaaagaaattaggcagatagggatggtaagagagtcctcaataaggttttccttttaatggagagcagcagcccccaaattatctcttttctgacaaagagcagcctgttaaattgaactgcagacatagataagcaagctggaagcttgcatggatgaatgccagcagctgcaccaacagaaaaaggctacctgggggcaaggcatgttcaacatagtggctccatctgcccttttctttgtcgagcacatgtacagtaagaaacagacaacatggcactggccaggtagagaacccatctgcataacaaaagattaggatggggtgaccaggttattcatgcactatgtaaatggcacacacagtcccatcaatctttaggccctatgtaaatcaggcactgcctcctcaagccagtctataaagctccgtgcactttgccgtggactggaagacccatttgggagcccttctttctctgcagaagagagagctattctcttttctctttcttttgcctattaaacctccactctgaaacttactgtgtgcctgcatccttgatttccctggcatgagatgatgaaccatggatatttaccccagacaatgatgctgcttcagtatgttgaataaaagtggtgaaagtaggcatacttgtcttgttccagttctcagggggaatgcttttgatatggtttggctgtatccccacccaaatctcatcctgaattgtagctcccataatgcccacatgttgtgggagggacccagtgggagataattgaatcatagggtgggtctttcctatgctattctcatgatagtgaataagtctaatgagatctgatggttttataaaggggagtttccctgcacaaactctcttttcttgtctaccgccatgtaagatgtgcctttcaccttccaccatgattgtgaggcctcccaagccatgtggaactatgagcccagtaagcctttcttttgtaaattgcccaatctccagtatgtctttatcagcagcatgagaacagactaatacagtaagttggcaccagtaaagtggtatgctgctgaaaagatagccaaaaatgtggaaacaactttggaattgggtaacaggcagaggttggaacagtttggaggattcagaagaagacaggaaaatgtgggaaagtttggaactccctaaagatttgttgaatggctttgaccaaaatgctaataatgatgtggacaatgaaatccagtctgaggtggtctcagatggagatgaggaatttgttgggaactggaacaaaggtgactcttgttatgttttagcaaagagactggcagcattttgcccctgccctagagatttgtggaactatgaacttgagagagattatttagggtatctggcagaaaaaatttctaagtagcaaaacattcaagaggtgacttgggtgctgttaaaggcattcagttttataagggaagcagagcataaaagttcagaaaatttgcagcctgacaatgtgatagcaaagaaagtcccattttctgaaaagaaattcaagacagctgcagaaatttacataatttacctaagtaatgaggagccaaatgttaatccccaagacaatggggaaaatgtctccagggcatgtcagaggtcttcatgacagctgcgaccaacacaggcccagaggcctaggaggaaaaagtggtatcaagggccagacccagggttcccatgctgtgtgcagcctaaggacttggtgccctgtttctcagtggctccagccatggctgaaaggccccaatgtagagcttgggccacggcttcagagggtgcaacccccaagacctggcagcttccacatgatgttgagcctaccagtgcacagaagtcaagatttgaggtttgggaacctccacctagattttaaagtatgtatggaaacacctggatatccagatagaagtttgctgcaggggcaggcactcatggaaaacctatgttggggcagcacaaaagggaaaaggggtgggtgcctccacactgagtcctcattggggcactgcctagtgctactgtaagaagagggccactgtcctctagaccccagaatagtagatccaccaacagcttgcactgtgcacctggaaaagcacagacaatgccaacctgtgaaagcagccaggagggaagctgtaccctgtaaagccacaggtgcagagctgcccaagaccatgggaacccacctcttgcatcagcatgagctggatgtgagacatggattcaaaagagatcattttggagctttaagatttgacttccctgcttgattttggacttgcgttggggcctgtagcccttttgttttggccaatttctcccatttggaacagctgtatttacccaatgcctgtacccccattgtttctaggaagtaactaacttgcttttgattttacaagctcataggcagcagggacttgccttgtctcagatgagactttggtctgtggacttttcagttaatgctgaaatgagttaagactgtgggagactgtggggaaggcatgactggctttgaaatgtaaagacatgagatctgggagggaccagggcagcatgatatggtttggctgtgtccccacctaaatctcatcttgaattttagctcccagaattcccatgtgttatgggagggacccagtgggagataattgaatcatgggggcgggtcttttccatgctattcttgtgatagtgaataagtctgatgagatctgatggttttataaaggggagtttccctgcacaagctctcatttcttgtctgccaccatgtgagatgtgcctttcaccttctgccatgattgtgaggcatccccagccatgcggaactgtgagtccattaaacctctttcttttgtaaattgcccaatctcaggtatgtctctatcagcagcatgagaacagactaatacagctttccacttttccccattcagtatgttagctgtgggtttatcatagatgacttttattacattaaagtatgtcctttctatgcctattttgctgagggttttaattataaagggatgctggattttgtcaaaggctttctctgcattgattgagatgatcatgtgatttttgttttcaattctgtttatggggtgtatcacatttattgacttgcatatgttaaaccatccctgcatccctggtatgaaacctacttgatcatggtgaattgtctttttgatatgctgttggatttggttatctagtattttgttaaggatttctgcatctatgttcatcagggatattggtctgtagttttcttttttgtcatgtcctttcctgtttttggtattagaatgatattggcttcaaagaatgatgtaaggagtgtttcttctttctatatcttttggaatagtgtcaatatgattggtacccattcttctttgaacatctgatagaattccgctgtgaatctgtctggtcctggactttttttgttggtaacgttataattaccatttcaatctcactgcttgttattggtctgttcagagtttctattacttcctggtttaatctaggagagttgtatatttccaggagtttatctaggttttctagtttatttgcataaaggtgttcacagtagccttgaatgatcttttgtatttctgtggtatcagttgtaatgtctcctgttttatttctaattgagcttttttggatcttctctcttcttttcttggttaatcttcctacatggtctgtcaattttatttatcttttccaagaacaggtctttatttcatttatcttttgtattgttttggttgtttgtttcaattgcatttagttctgctttgattttggttatttcttttcttctgctgggtttgggtttagtttgtacttgtttctctagttccttgaggtgtgaccttagattgtctatttgtggtctttctgagtttttgatataggcatttaagactatgaactttcctcttaacactgcttttgttatatccaagaagttttgataggttgtatcactattatcattcagttcaaataatttttaattttcttcttgatttcattgttgacccaatgatcattcaggagcagattatttaatttccatgtattggcatcattttgagtgttcttattggagttgatttccaattttattccactgtgatctgaaagagtacttgatatgattttaattttcttaaatttgttgagactcattttgtggcttatcatatggactatcttggagaatgttccatgtgctgatgaatagaatgtatattctgcagttttggggtagaatgttttacaaatatctgttaagtctatttgttctagggtatactctaagtccattgtttctttgttgactttctgtcttgatgacctgtctagtactgtcagtggagtattgaagtcccctgctattattatgttgccctttttaaactcctatgtgtcaattaaagacaggctttttccatctagtgaatccaccattccccagggccttagagtcctaccttagatgggaaaactagaccctcatagacggccaattgctccttcacatctcagtccagatgcatggggcccagaaaatgtagttcaatgatttgacaagaagagaaaaatgttggtattagggagttctagaaatctttgccttcagattacagaagatagcttttatcttccgactatattttaaaatttaaatggtattaatgatattaatggttactaatgtctttctctgttttttcatgccattctattttatatgtaataaagaacttaatatgctgttacttttcttgcctttctcatctgctgttttcaatgttcagtttattattattgttaatattgttgttatgatataatttttttatgcaactattttctctaaatagcttcagtacttatcagcaattcttaaactttcccaatcttgagttctggatcttgattaatctttctgtcttctgaagaagattattggatagttttatcatgaaacttaaaaagatcaattaattagttttatgttctctaaatgtttggtgatataagaaagtatttctctcatctttgcacattctcttaaatttgcccaaataagaaagtatgtctgttgtttttacacataagtaaccatttaaatgtgtataaaattcttggattaaactatttcccctcaaaacttgttgaaattgttccattgtctttcaacatttgacattccacataagaagtttgaagcttatctgatttttttctcctttataaatgttcctaatttttggtttacctttaaaatgtttcaatattccatgatatgtctatgtttggatatattgtgattattttggagaaaactgtattagtctattcagtttgtagacataagtcattttgggtaaggtttattggggcatttcatatccataattatttattgcatttatttttaaggtaattagactttttctgttctcgatgtctataatttttactttcactgatgtccttgtcattttcctgttaattctttgatattgtgcatttttaactctgctcatttctgctttcaacgtacgttttaattctgccattgctttacatggttccttgctctcctttcttatttaaggcagacccctttacatctctgtctttgtggctgtctttttatgattttacaaacctacttcatagaggcttctttttcataaagtaatgtcccttttttatttttggtacaccatgcaaatattttataaaacctccatcccattgtcatagaagtaatatacacaaaacttctgccttggaaggttctagacaagatttcccttgtcttatgctaggaagaagccttgtaacttatgtttttctatttaaaaaaggagagatacattcagacccagcttttctcaatagacagggagggtgaaatttacttgcctcttcattcagctgtttccatgttaatagccttcctctctcagaggtaaaatcaaggtcatcagcctttaattttgtgctggtctattgaactgaagatgtatcttctgtttcttagatggttcactgacttaggaagagtacatcaaagtttaaagaccttatttgagcaatgaaaaagatgcttctatgcatgtactgctcccagaacttctcatgtgataaccaggaacatgtataaaattgtatgtgtttctacatttttctatgttttggacttccaagtgtaacatccacatgagtggagaaacaagtgttgaagcaaatgttggaaacagggagaataggccagaaatccggtacttgttacccagaagtgctgcctgtttctgttctcaagagcctccatatcatgcagtaagacataaacaatggaacggaatcaccatcttttcctgttgtcctaggttctgttctgtttcagagggactggcatacggtgcatggctaagaaaggacatttaatggggtctcatccagacattgacatgtgatctttgctcatcttgaacttgtgctagtggaaatatatttaatgtatctacataggtatattaattggaacttgatagtgcagataacaggcacatttaataacccaagtgaaattaatttatatacgtaagtgaagtttgaaagcatttcattaatattatatctttagggcttgactttataatcagcctgctcacttaacaaactaaaattcaacataaactacaaatctagtacactttgcattataccatagcagccacaaattaatgagtaataaataatgctgtgagacagtagaaaatgatgctagtaacagaagaaacgtttgcactcactacacccatggctttgctgtacttgacgaatattatcattcaggaaaatgttaagggattttaatagtcagttcctgccgatgatcaataatgacctcattattgcatgtgcttacatttttgtgacatcagaggaaagaaacactgcaaaacccagaattttccaaattaattgctaaaggtcttccaatacaaactcttccaactacactggcacatcatacccttttaactatttctagagctaaagtgaaagcagtagtgtatttaggaaaaacaaaaagaaaaacctagtattcagtttttatgcaaaatcaccaagactttaatgtaaaggggtcctttaaagaaacatactattctcaaagctatattactttatatggccatatgctgggatctcacatataagtgaaattggacttcaatagccataaggagaaatgccactttttcctcccaatccttggactaatgctgtttaactttttttctttttttttttttcctgagacatggtctcattctgttgtccagcctggagtacagtggcacgatctcagctcaccacaacctctgcctcctgagctcaagccatcctactgcctcagcttcctgagtagctgggactacaggtgtgtgccatcacacctggttagtttttgtgtttcatgtagagatggggtattgccacgtttcccaggctggtctcgaactcctgagctcaagtgatctcagcctcataaagtactaggattacaggtgtcagccactgtgcccagcctgagcaatttttgatgcataatttgacatgaaatttcagaaggcttgtaagccaacactccacccccatcctaacaaactaaggtaatcgtttctgcttaaaagtctctgaaaataatactgatgtaagtagagcagcataatacttcctacctaagaaaatatggctgttttcatgttctcttgttaaagaatcattgtgggcagataatgagaagcagagcctaaggaaaagaatggataaattgggaggaagaggagaaaaaataatagactggtctttgaaaggataagggttgaagaattgatgagttatatttgcaagacagttagtgattgattttggtatcttttaaaggcttctctacattatagaaacacattgaactagaagagaaggatgagagccctgataaaaatttaagtattatcctgagccagtccttaaggggagcatgctatgtagccctgctacattgacaatgtatataaaaggatatctttctaagcatccttctaggtatcagttagcgaatgttgttagcaagttaaaaaaatgtctctaggatctgtgtcaggaaatgctcttatttgtattagcctagtcttctctctaagattatgttacttatgagcagaagttgttctatgtactgtatactttcattttcatcttagtttcctttcataagtgttatatcaaagttctgatgattcattgaataattataagtagcaaaattaaaatatttaaaggaaattaaaaagatgagacttttataagactcatattcctacataagactgcaattaattatgagattgggaaaaaacgcaaattattaaaaaataaaaactgaccaggtgcagttgttcatacctctaatcccaacagtctgggaggctgaggtgggtgaatcacttgaggccagaagtttgaggccatcctgggaaacatagcaagaccctgtgtctacaaaacactgataaaaattaactagtgtgatggcctgagcctgtagtcccagctacttggaaggctgaaacaggaggatcgcttgagcccaagacatcaaggctgcagtgagccaagattacactactgcactccagcctgagtgacagagcgagactctgtctcaaaaataaataaataaaataaaaactatcaccaccagcaccaccaaaaaggagatctcataagctttttttaacatttccaaaacaaaggctctctaaacttctttttttctcattctagaaagctaatgatagaattttttttttcccctgaaagcctcagctacattcaccatgtcctgcatttattgttgacagctgttcaagacctacaaggtgaagttgaatattacacacttttttggagttctgctacctcaaacgactctctaaaaatcttgccagatgtaaactctcatgtcattggccacctaaagccaaacacagagtattggatctttatctctgtcttcaatggagtccacagcatcaacagtgcaggacttcatgcaaccacttgcgatgggggtgagtccagattctaaaggatatttgcctcagagatgcgaatgaaattgattgattcttgccggggttgagatcagtcatccctccattataaaatttccggtgtgggagggaagggggtggaggctaaaatgcttaagtgctcactgtcatcagtagcagatcaataagcagtcccattgagacagaagcacaagctctaataatgagatattagcccagtttgttcctgttcttttcagtgtatacttattttagaactgagttcacatcaataaatggtgacatttagaaactttttttttaagatttgccctcagaagcagtacgtttttcaaaacgacagccaaacacagtgagagccctccctgagtcaccagaaatggtaggtggaagttcagccactgagaaaaattgcctgtgactcatttctaagccagttagcaagggggaggaagcaagggaagcaacttgtgaatctgaaatgtgtttggaatggtctttctaatcttttttggctttataaagtctcattataaacattataatatcattacctcccaagcaagtgttccaggtcattagcagagctctttaagtgtggaacccatttccctttgtggtgccaaaggtcggcaccttttgtttataaaatagggtagatcacaaggacaattcttcaactagttaagatgggttcttatgataaaaataggtctttgcatagttatttctgacatgcttgaataattatgcaatttaacgctaagcaagatttttttcttatgttagatttcatcattacctatggtaatcaacattcaaaatcatttacataatgacaatattgcattattgcttcatattgcttgagttacaagctagtaacatcaaatgatttttcacgttccaccagcctcattgtatttgagttttattttttgctcaaggagcaaattttatttccttccctccctcccctgcaccttggaggtatagagtgaaaggatggaaaaaagacaaaaaatagataagtgttagtggtgcagatgggtgaataatttatcatcatatcccactggtcacatagtattgaagattagcactatgctggtggtataaagcattttaccaccaattcttatggtttctaactgagagtataataagccaatttacagaggactacagactgtgataacttcatcagcgaaaagcagataagcgaggaaccctttgctaaacctaaatactaatctgcatttagcttaacatgtgctttttcagagacagctggagtttattcagtttcttcctttaattctagagcctcagggcatgcttcctccagaggttgtcatcatcaacagtacagctgtacgtgtcatctggacatctccttcaaacccaaatggtgttgtcactgagtattctatctatgtaaataataagctctacaagactggaatgaatgtgcctgggtcgtttattctgagagacctgtctcccttcactatctatgacattcaggttagaacattgttttttgatggttaggcttatggatatgttaaataaaacatgccaggctatgtcttcaagtggatatcttctgtcttggttacagattatttctttggtggggaagggaaaagagagaagggaaattgatcagaattaaatctgtgtgctgtaggcaaacatgtgagtctctggagagaagataatgataatatggaaaacgatggtgatgaggatggtgatgaaattctcactggcaaaataaagctaatcatgtattctaaataaatcttgttgagcagcttaccttttcccaggatcttttactgaaatcaaaatcagaatcagtttgtaaatgtggagatgtttttttctcttcccatttctcctatttactaatttaatatctccagagaagttatgaaacttcacttggtgtcaatttcctcttttgtaagcgcaatggactagatgtcttaaaacattctagccacctctagcattctgtgattctgaatgcaacaggaagacatatataaaaaatatagcagacaaaaaatattaaaaggttttatctgaaggtgaaagaaatatatttattcatcactcaaaaaatgttcaatgttctccgcatatgtgagagcaattgtggttaaaattttttgcccttggacttctttgagaatcttatgaagtcagtgtactctgccttagaaaaatatttatgcacttgtatgacaaaatttaacacataatttcagaaagtgcactgatcacttgaagtcaaattcatagacttcttcaggggctactggccttaaaagtagaaaaagtatagggaatactaaggcatataaaacaaggaacttatcttcacggaattggaaatcttgttggagtaccaagccataaaagataacaaggctaaatgtgcaaatgagtgataaaaaaaaatcagagtatttcagaaaccccacatttagagaaagcttgcaatttacaaaattttttaataaactatgctacttctaaaattcataagagcttcgtaagataattttcagaagatattaagcacagaaattttatatgaccacagaaactttttactggttctatccatttaatagtactacctcattcaggtttccatctccttttcctgacatttgaggttaagacatataatcatctggctacaaccaacactttagtctcccctactctgactcatagacctagcttcctaagaaaaccaaataaaaatatctttgaataaagaagaaaggtacattaattatttttctttttttttcatttaaatgtattttattttaagttcctgtatacgtgttcaggacatgtaggtttgttacctaggtaaacgtatgccatggtggtttgctgcacctaacaacccatctaccaggtatttacctgtacatgtattattagctatttattctgatgatctccctcccctgatgcccccccaacaggccccagtgtgtgttgttcccctcgctgtgtccatgtgttctcactgtacagctcctacttataagtgagaacatgtgatgtttgtttttctgttcctgtgttagtttgctgaggataaaatggcttccagctccatctatgtccctgtaaaggacatgatctcattcctttttatggctgcatggtattccatggtgtacatgtaccacattttctttatccagtctataattgatggacgtttgggttgattccatgtcattgctattgttaatagtgctgcaatgaacatatatgtgcttgtatctttataatagaatgatttatatttctttgggtatatacccagtaatgggatggctgggtctaattgtgtttctggtcctaggtctttgaggacccaccacactgtctttcacaatggttgaactaatttacattcccaccaacagtgtaaaagcccttctatttctccacagcttcaccagcatctgttgttacttgacttttcaataatcaccattctgactggcatgaaatggtatctcactgtggttttgatgtgcatttctgtaatgatcagttatgttgagctccaggtgcccaccaccacaccaggttattcttttgtgtatattttcagtagagacagggtttcaccatgttgaccaggctggtatcaaactcctgacctcaggtgatccacctgcctaagcttcccacagtgctgggattacaggtgtgagccactgcacccagccaagtatctactttttgaataatccctttatatgtcccttttacaaagaaataataatttcatttttattcagttttacctctttttaatataaatatagtaagctttatatgtttgttggccgcataaattcttctttggagacgtgtctgttcatgtcctttgcccattttttttgatggggttgttttttcttgcaaatttgtttaagtttcttatagattctagatattaaacctttgtcagatggatagattgcaaaaattttctcccattctgtaggttgcctgttcactctgaggatagtttctgttgctatgcagaagctctttagtttaattagatcccatttgtcaatttttgcttttgttgcaattgtttttgatgtttttgtcatgaaatgtttgcctgtgcctatgtcctgaatggtattgcctgggttttcttctaggatttttatagttttgggttttacatttaagtctttaatccatcttgagttactttttgtataagatgtaaggaagggatccagtttcaattttctgcatatggctagccagtttttccagtaccatttattaaatagggaatcctttccccactgcttgtttttgtcaggtttgtcgaagatcagatagtggtaaatgtgcagtcttatttctgagatctctattccgttccattggtccatgtgtctgtttttgtaccagtaccatgctgttttggttactgtagccttgtagtatagcctaaagtcaggtagtgtgatgcctccacctttgttctttttgcttatgattgtcttggctatacaggctcttttttggttccatatgaactttaaagtagttttttctaattttgtgaagaatgtcattggtagtttaatgggaatatcattgaatctattaattactttgagcaatatggccattttcatgatatttattcttcctatccatgagcatggaatgtttttccatttgtgtcctctctgattttcttaagcagtggtttgttttcattgcacaccatgattcccatagcctacctgagttgtcttagcatggaatatgtggactgatgtttatgttcatgattcttatggtgagtccatgtatgcaggtagaccataggccaaattatgaaatagaaatcatgctccaaataaattagaaatatagctatataaaaaaggctaacacaggaaggtgatggaggatttgccgtattgtcttcttttgaccagtgttcgggaaagctgagttttcaaaggcaccttattcatttgctttaccaagactcgaaacacacaacctagaagtgagaacactgtgtgctgtgcatgcatgtgcagctcagctttctgactctggatcaagagttaacgtttaaaagtgtttaaggcctattctatggaaaaggctttatttataccactactggtttgagtcaggtataaataactcaagccagtaggtataaagcctcctcttctggtagcctgaggagagtggaaacagatgaaaatacaaaagatcaaagtagaatccaataatagaattttgttattagtgcctaagatattcttattactgattactatattttttgtgaagctttttgcagtccaggaatactgtacttgatatagctgttgcatttctggaaatttgaacatcaaatttcagtgattttcattacgatgtcaaaggtgatttagtttcatttaaaataagcatttgattggaatgcctaatactttagaattaaggctctctatgctaaccccatctgtaaaatagctattgattttaaagcacataacacactcaagtatctacttttttttttttttttttttttttttttttttgagacagagtctcactcttctcacccaggttggagtgcattggcacgatctcggctcactgcaacctctgcctcctggaatcaagagattctcgtgcctcagcctcccaagtacctaggattccaggtgcccaccaccacaccaggttattcttttgtgtgtattttcagtagagacagggtttcaccatgttgaccaggctggtatcaaactcctgacctcaggtgatccgcctgcctaagcttcccacagtgctggaattacaggtgtaagccactgcacctagccaagtatctactttttgaataatccctttatatgtcccttttacaaagaaataataatttcatttttattcagttttacctctttttagtataaatacagtaagctttatatttgtgtttcattcacatgttatacaatatcgttttagcactagaaataggtcccaaaatggagactgggaatgttaacattagtaagaataaaaacatattggcacatttctctaacatttgaggttaaaacatatataatcatctggctaccagcagtagtcattggtcattttcctttgaccaatgaatcaaaagaaatgttttctggagaaacatttgaatatacctaagtagtttagagcttaaagttatgtttaacatttagatgagaagccagtagggtacagtggagaacaactcagatatcccaaatcttaccagcttgacaatattccctggcttctctgcaaatttgtttaaatggagttatgaggaatcaatacgattatttgtgcatatatccattataatatttggcacatattagatacataataaattcagttgaattgattctgggttatctcattatgtatcacagaatcaaatttttccaatatgtataaagttcattttcattaattatattacagcattatattttaagttcatctgcctttatttcagatttaattggacatgctcagaatgtaggcccttgatagtgtttaaatatccactattaatacctcaaaagactatatggcatcaataagtaacacaactcatacagcattatgaacatatgcctcaactaacatttaggtaccctatgaataaaatagcatatctagtaaatacaagaatcccatttgcctttcctcaaccaccaaaggaacagagaactgtttcacataaaagctcggaattaatgtttaagattcatcagtacctagcttgccttctctatttatatattagatgcttaaagtaaattagcactgtaaaaagtacagtttctctttggtttatcctttaattgagagcagaatgatatcgctttgcagatgttcccaatcttttgcatattcatttctctctcctccctcttggttaacgtgttccttttgtgtgactaatgcttgatgaaccccatttctaatcttcagttattccaccctcctcggtttttattcagattaggtggcagaattaaagggatgaatgatgattttctgctgtgattaaggtaaaaatacaattgcatctggaacaaatggatataaaatacctcagccatattggaaggcttctctaggcctcatttttcctccattagacattagcatttaggctatttgttttacagtgtcaagacttccagaagataccatcattacactacttagttatagatttagagaacagtgagcagtgataacctgttatgcttgcaaactgtcacttgggcatcttccattccttgactatgctcttcagtagattaatgtatctttctctttgtgaatagttgcaaccagagagtaaacatcatcattcccattactaaatcaattatcttgatcccaattccgtaccttcctctgagctcattcctttggagtcagttaacatcaaaaatgaatattgattaaacctcaagaggctatagagaaatacaagagattcatgtgaaatgagggaaggtgggattcagactattgttagtaagtatttcaaaaatggttgcatttattttttctaaactaatgtttgcaggttgaagtctgcacaatatatgcctgcgtgaaaagcaatggaacccaaattaccactgtggaagacactccaagtgatataccaacacccacaattcgtggcatcacttcaaggtacaaaattttgtgtcagttaaatctaaggaactctgatcagaagaaatgaaaataaaaatcaaaggtatcctctcagccatgacaatctcatttaatgggttattataagtatgtgtgtaaatcaaatttttgatattatttcacagatattaatcttcactggacatccaatggcatttaatctttaatttccctgattgcccagcctcagatttcttatttagtaacctgtaagcaaatacttgaaatacatgtctccttatttgaatgtgtcctttagtgaatccttttgcggagcataatacaagcttaattgtaatgactaccttctaacttaatctttttgaaaaaaaattgatttatatacatcagagtgccctaaagctagaaatctgtaaaattagtagggcagataatgtttagataagcattaccaattttgtcagcttcttggtagaatcactttatttttctttattcttttgttgctgagaaatgaccatagtttgaaagcgagtctctttataattcataattagtaacaacaacaataataataatatttggtattgtttccaaagctgaaaataagatggtaaattgttcatccgtttgtatcaagttgaggctgggaaaagaaatcttagtgctttcacattatactttttgcttaagccaaatgaatcacccttctcttacatgtgcaaacaacacacacacacacacagacacatacacacactgaaataataagtctattattaatgtttcaattctgaaggatttctctatgacatgttgaaatttctggatcttaaatcagttcaaaaaattagtactggttttggcaaccaatggttaaaataattagaaaaattcaactaacctgactgttagctgttcgtggcaataatcatatcttgtctgcttgagtatatcttctatcaaacacatgatagatactgatctaatttttggcatactaattagtttataatccccccagcagatatcccccaacctattcacagtattatctactatgcagggaggaaatagtcatattaaatgggcgttagagacctttattctttagcaaacacatctgtggctataataatatagaaggcaaggtggggcgtggtggctcacgcctgtaatcccagcactttgggaggccgaggcgggcggatcacaagctcaggagatcgagaccatcctggctaacatggtgaaaccctgtctctactaaaaatacaaaaaattagcagggcgtggtggggggcacctgtagtcccagctactcgggaggctgaggcaggagcatggcgtgaacctgggaggcggaacttggagtgagccgagatcacgccactgcactccagcctgggcgacagagtgatactctgtctcaaaaaaaaatatatatatatatatatatatattatatatatatatataatatatattatatatatataatatatattatatatataatatatattatatatatatatataatatatatacacacacacatagaaggcaaaagtaatacaaaagagcataagacatgattctaaatttgcaaagttccagtccactggggaagatactcccctaaataaatgtttatagaacaatgtaaaaaacactataataagaggtttagatgtgcaagaacataaagagaaaaatagcaaactttacccagaattatcagtgaaggcatcatggaagatgtgacctttgacttcagtcttgaaaagctcaaggaagaattatagttaggtgggtggatgttttcaaattcttgtctgctggcatccccatgactcaagcccatgtgaatgacgtaacagaatatgcctcatagtacatatttatttataactaaaaataacgtctaagctttataagaaatggaacaaatgtgactgtgtctctaggttttttttcctttaagaagattattgcacataataacagaggacaaatatttttagttgctattaaaaattgcttgtatccaaatacattaaattgatgacagaaacattaaaaagagtattatacaacaagaacaaggaaagtgagagaggagacaacaacagaaaagagattgcaacacaattttgtaagcaatatttgtcagaaagaagcaaatgatttaatacagtggagaaatttacaaccaaaatattggttgacaaaagacaataatgacaggaaacaaactgttttttccacagagaactggagaggctgagcacttagaagttttaaggatgtaaagaggaggagagagggtagggtttaaagctgaaatcatggggtgagacacaactgttaacaaataagtgtttggaatcccaggtctcttgcatctttgctgtgcatccaggggtctatttctcttcctccacatgacaaagtccaccgaccaggagattagacatttattctctggagaaactgagggctactaggcagaggggagctgagatgagacacagaagtaaaaacagtgataaagtgagactacaacctgaatggtgggctttttggctaagtttcccagttctgccctcaaaagcaagtagacaagtcataaacacctccagataggaaactgaacatagttttctagaaaaaaaagaatgatctcaaaaaaaatacctccagataatagcatatagggatccctaacagtaaaaacaacttgtcctctggtcacccagtagggaagtatgccaatcaacaaggctcacctaactataaagcttttagtcagctttttttttttttttttttttttttggtgcatcactcttaaagataaaaaggggaccaaaataaacaaaagacatgatacaatagattcagagataatgcaggtgaggaaaaaaaattatagcctcagacagataaaagaaaattctctaaccataaaacaaaaccagcatacttaaaaaaataaataaataaccaacgaggagaaaacttcatggaaattaaaagggtgaaaagctgaattgaaacttttgaagaaagttcaagggaatgtctctgaaaatgcaatgaaacacaaagatttaaaagagagagagacaaagaaaaaacaatagagagtatccaggaagtctaatatttgaataataagagcttcaaaagagaatcaaaggaaaagagggagaaaatttaaaaaaaaaaaagacaagaaagtatcccagaaccaatgtactactgtgcagatcaaaagattccctggataccaacaatatgactaaaaagtgattacatataaagggatattatcaggaaattgcagagtaccatgtttaaaaagcacatccaaaaagctgccaggaagaacagacactaccacaatcaggatgtgaagcagcatcatgatgtcggtctccattattgctaacccctcttctacccttcctaaaactaagcaaacactgccatgttttgttatgtataattctgccttttccatattgtcatgtaaatggatcacataatatgtagccattcaaatggcttcttttagttagcataatgcatttaagatttgtccatcttattatatacatactagcagttgtatacatactagtagttgtcagtttttgttgctgagtaagattccattatatgaaagttctacagtttgtgcacagtttggataattttcagttctccgtgaccacgattaaagttgctgtaaaacatctatatacaggtttttgtgtgaagatatattttcatttcatgtgggtaaatacccaggagttggattgctgagtcataaactgccagactgatttacaaagtgactgtaacatctttcattcctactagcattgtatgagagttcaagttgctctacatttttgctagaacatgagatactatgaggtgttttcctcttattttttaaatagtcattttaatagatgtttgtggtgtgttattatggtcttaaattacattttccctaatgactaatgatactgataagctttgcaattgctttttgcatgcactttggcatttgtttactctgggaaatggtatctccaaatcttttgcaaatttcttaattagattctttgttttcttattttttgagttttgaaaattttttaaatatattttggatttgagtttttgtcacatatgtgatttacagatatttcttctctaccttatgatttgttttcaattatcttatttgtgtgtttttaagagaaagagttttaactttccaagagagttagatttgttactttttccttgacagtttgtgcatctggtattttatctaagaactttttgcctgagttaaggtcacagagactttctcttgtctatttcctagaacatttgtatgtttacatgttgaatttatgtctatgattggttttgtgttaatttttgtatacactgaggcatgagtcaaggttaattttttttggcatgtaagtatttaatagtatcaacaaaatttttggaaagattatcttttctttattgaatatttttagatttttgtcaaaaatcaatttaaacacgttttgtaggccatttttggactctcttttatgttcaatttatcaatatgtatatctataccaatatcgcacaatcttgattactacagctctatagtaagctgtcaaatcacattgtatgagtcctccaactttgacctttataaaaatcattttggcctttctcactactttgcctgtccatataaatttcagaaacaggtcattgatatctacaaaacatgtgattttgattagaactgcattgaatttgtggatcaattggtagagaattgacatcttaacaatatcaaatgttctgattcaagaacacactcttgctcatttatttgcatcttctttcctttattttatcagtgttttatataatccagtatgcaaatactgcacatattttattaagtttatacctaattacttatttggggggtgctattattattgtttctttaaaacaaattcaaatccaattgttgctagtgtgtagaaacacaattaattttggaatagtgagcttacatccagcaaacttgctaaactccttgtaagtcttaagagcttttttgtaattccctagtctatatagatcttctacaaagagaaactgtttatttttttcatttccaatcagtatgtcttttatttctttttcctgccttattgcactggatagtttaataacgtgataagagcatatccttgacttgttcccaatctttgaaagaaaactttcagtcttttacccttagatgtgatgttacgtatgaaatttttggccatgccttttatcacgttgaagaacttactttttatttttaatttgctgacaattttcattataaatggacatggaaatttgtcacatgcttttttgacattttaaatttgtactatgatcgattatatttactgattttaaattattgaactagtttgtattcgctggataaccagaacttcgttgtgacatattttcttcttcatatattgggggatgcaatatactattatcttatagaaaatgttcatctgtgttcataaaatatattggactgtgtttgattttcttgtaatacctttgcctggattgggtatcatggtaatttctggtctcatactaacttgggaagcatttccttcttttctattttgtggaagagattgtacaaaagtgttattatttcttaaatcttggtaaaattcaccagtgaaacccatatttgcctggagtttttctttgatggaaggttttttaacttggaattcaattcccttaataatgtatgatatttggcaatttattctccagtgagtttagtcatcttgtgggtgcagaaaataggttaatttaatcaaatttgtcaaatttattagcaggaagttgtttgtagtatgtttgtactacaaacaacaatttgttgcaattgattttattctttcatttctgatattggtagtaagtgcccccgtttttctgttcagcctagagttttatcaattttgtagatcttttcaaagaaccatttttggctttatttattttctatatcatctacattgttttctattttccatttcagtgatttctgctctctattgttttcttccctcttgccttgctattgcttctctagtttcttaaagatgaaaactttcattattgatttgagacctttcttcttttctctcagtcctgcttcggtatgaagctcacaaattttgaaatgttgcattgcacttcatttattcaaaatatattttaatttctcttgagacttctttaacccatggattatttacaagggtattgtttaatttccaagtatttggggatttttcagataagtttctatctgagtttccagtttaattctattatgatctaagaacataattttagaattccaattcttttaaattagttacagttttttcagggcccagaatatgatctatcttagtgaatggatgtgcacttgaggagaaggtacagtctgttgttgtcagatagagtgttttgtaaatgtcaattagatcaagttgagtgataatggtgttcagatcatctatatacttactgattttctgcctgcttgttttatcagttattgtgagaatggtgttgaagtctccaaatgtcattgtggctttatctatttcttcttcagatctattagtctttccttcatgtactttgatgttttattattaagtgcatacatgtttaggattgttaatgtcttgataaactggctcttgtatcattatgtgataagcccttttacttcctgataatttccttgttcttaagtttattttgtctaatattaatatagccactccagctttcaattgcttagtgtaattctgggtgatttttcgattgattccttcacattttgaatattacgttataaaaatctgactcctgttaaaatcctttgaagaaagttagagttcttatttacttttttcagcaggttaccaactggttagcttcagactccaaattctgttttcctttgccagtgactacagtcagttcctattttttcataaagtagcataacaaagctataaactttgctttactactctgtgtctgcacaatggctaatttgggatttggctgtagaattatgtaatagttctgatctcaaaatcttcgctgtgctgcttgcataggctatgcatgtgaggcaaccataaatgtgcagcttggagttgagtcaggacttgcgttcgttcattcataaaattagcttctagctttcttctctctgaaatgtcccccatctttccagctcctttggacttccttccctggatttttggctagaatgatatgatttcttttgaaatgtttgcctcccagcctgcctccaaatttgcataactggagttgttcttaggcaatgaggtaagaggaattcgagaaaaaaaaataacaaggacttcccccacattctttggactatagaggccccatttcctgatttctctggacagaaagatttttccccccgttggggctttagattccaatttggccacagctgccgcagtgcagctccttggctctgatcatcctcggagcagggcccagcagaaagaagacaaaacaaaacaaaaatgggggttttccctatactctctggcttgcaaggcattttgttctagatactctagccggaaaaaatttactttctctaggattttgcttccctagttcacagtttcacactgatactgcccttgggttaaagatgggaagtaaaggagggggaaaaaaaatgggaaactcaccctgtaacattcattcttaaagttttgtctcccctcctgatcagccttattgttagcttttcagagtcctcaggtagttactttatataatttttgcagatactgagttgtaatcagtgggagagataagctgtaatgggcttattccatattggcctgcatgggaagtccccctccaccacagttttctttcttccaatgcctttggcaactttccttttcccccccagtcagaagcctagcaaaaacttgatagaaatcattcataaccaaatattggcatgtaaaatctttcctttcttaaaatgatccatagtagcagagtaacattttccaaaggcaagactctaatgagcaactataggctgccaagccattaatcaaaattataccaacaccaaagcagttagccttgtgtgtgtatggtattgtttgtgtaatttcattatacttctggcaatgtatacttgttagttatgtttctattttggttttaaaaaatctttcatattagcaacatgcaaaatgaaatgtgaaatccttccagaaaaacatcagcagacggggtctacttctctagcatttaaaataatttggtttctaagaagccatacatttcttagattctttgtttatttttggtgaaattcagaagtcagtaaaatttaactcatatatttcaataacatacagatagcataccagcctgtttgattatatgcgtgcagtgtaccaactcatctttgtctttggccttaacttatgccttgtttttgactacatcttcagcagtacaagcccttatgcatgtttttcctcttatatataaaccaaagattccatagcacacaaataatatagaagaatcaaatggacccttctagttttataagctgctgcttcagagacaagccctgtttctacattgcattttccatacttctcatattatcatcagctccttctatatcccaaaagaatactaactactgatcgataacccggacatgtctggccatggcctacatgtgccctgggtagttcatttatttgtcttggtggatttgctagagtggaatttaatcaatagctaattcattaattctggtcctcgagaatgtagagactgacctggatgaagataacgggctgggtctggctttgatagaaatatgacaaacactgcagctgacagcttcactaggtactgtgctatgaagtttagttatttattccccataaatggagacactaagaaaataacacaaacaagaaagatgttttattacattactgttagtattccaaaatgcatcatttccaggcatgaggctcaagggaaagtagagaaagaactcagatcatgtcttttaatgtctttaattggaaccatggcagttttttcacatccaaatcagtttggggatgtgttattgataaggagtgtgaggtataaagtcttcgtagcactcacaaataattgttttaagatttgcttctagatgctgaatgagatcaatgatattcttatacacaaactttgcagaaatctttctgataacagcataggttagatgtctctaaatgaatgctaaaccactatcgttattaatgaatatctatatatttttttcttttttgttgttgttgttgagacaggatctcgttctgtcacccaagctggagtgcagctcactgcagccttgaccttccaggctcaagcaatacttcctcagcctcctgagtagctgggacaataggcatatgccaccacacccagctaatacatttttaaaattattttgtagagttggggtctcactgtgtcgcccaggctggtctttcgaactcctgggctcaagtcatcctcccgccttggcctcctaaattgctggtattacagatgtgacccacacagcacccggcatccccctatatttttaaattacttaatgtggggttaagtatggttcaagaggtcagagcttgtggagaaagaggattctccttttttcctcaccaaattttatgagacatgctatgatatactttttatgctatgacattagatatcagggaatctcttctatccttgattttttctgcctaacttttctcagtgaatgatagcttcaactgaagtaatgattttacagttttgtaaaattaaaagaaaaaattaatattttacatttaatttaattatttaacattacaagaaaaaattaaggccacatttctgtttgtttgctttaatagggagagtgttgggctgaaggatacagaatgtcaaatcacttgttttcacctgtataccaaacttgcttaccaatatgggcaattgtagactatttttaatatggactaaaactgtctgcttaaacctttaaaggatatgggtagaaccttgaaagagagaatttggactacactaagtgcaattcgtacagatccaatcaatagccttatggtcaccatggcttttaggaaatattactcatttgatggccatgagttctgattatcacattctgtttaaggagaccttaatagaatagtgtcagaatatagaatgtaaacagaaagacagaatatatagaaaagagaatattgggcttattattatggctctgctatcactattttcatttccttacctccctcttcttcccaaactcctcctaacttctttacctcttgtagctcccatagaaacagctcggtcgctgaagtagcctttgagtgcctttcagcaaaatccagttcttcctcctaattcactttagccctcaactgccactttgtccctggttctctaaacattcattgttttgttttgtttttattggttccattaaaaacccacttatgcattctgggtgtcctcaggaaaaagactccctaccttgctcaggtagttcagtcttgcaattttaagccatactgatgtctcaaagatctctggccctgttttcttcctaaactctaatcccacatacccacttgcctattgattttatgtcatgatattcacccatcacttccataaccatgagattcacaagttaattcttatctaactcatcatcttttccaacactcacttctgcaaatgtaccaccatcctgcatattatcgaggacatatatctttgaagtatttttaatcccctaagtttattaaacactgattttagtacattttctgttggagcatcttctcatatatgttactcttctccatttccaccactaccaccctggttcatgttttcatcgtttaagtttatataaccattttatggagctgtcttaatccaattagatacaaagagaaaaaaaaatcctttacttttcacctgctacttactgccttaaacacactgttttggctatccttccctcaattctcaaataccccacaggaacatcttatgggtttccaattatttttagttatgagtctcactttgataattaagattcatgatcaagtattaaaaagtccattccatcaccatcaaaatattagcctcgcatctagttcaaagattctatcatttctaaagctcaggcctaattgtagcttgctcttttcttccctcttactctttctttcctattccattttatccaaatatgttccctttcaattttattacttcactgccatcactgtttgacaatcacagctctccattggcaagtgatgctttcttgggcaattgtatgtttttcttgagaggtcctcatgagaatctttgaatagccaaattccctcacacgagtgttgccctttatagctgatcacttgtggtgccaaaagagcagaacattccaaagactcttcctgctggagtctcctcatgccagaaggccactgtcctgggccatgtaccttcaagttagctcaaacctagccatcttgcaaggcatccacttggctcttgagaaactcatccatctatgccatgctatagatcaatattgtggtattctaggcttaacctttcattgcagaactgctctggccaatctctggccactagaattctctaactgagaagtaagctttatttcctatgctcatacagactgccaaatttaagagttccctgtcaagctgtcccaagatctcttcaccacattttcctccaaggacaaaaggagggaaatgtgtgttcctttttattaaaagaacatgggttttgcattttgactttttacctactacaatttataataaacatctcagtaggataattaaatattcagtgacttgacttgaaagcaaagaattaaatttgtcatattacatttatttcatctttgttaaaagtgttctgatcatttttgataaccatgatctggaataatattgaagaacttgagtgttacataaatgattgacaaaaatgaccaaatcgattagaaaaaaagcctgtgtaaacataaccagataatctagagctatttaatccataacaatttaggttaatatcttagagtgtatgaagatttcttttctctggtcaaacaaaaatgttttgaaaaaattggggaaaaatattagaatgaaatgttaaagaatagtaatgtgaacctgtcttcataaaaatttgatctgacttgtatcattttgatattcacctgtgtaaaggtaagtgatatcaaattattttccctacactcctttgtatcttcaatggtattttgtacttcaagggacaactggaagtgatgagatctggggagggtgaaatgcatctgtaatcctaactagttgggaggctgagtcagaattgcttgaggccaggatttgagtccagcctgagcaacatagcaagatcccatctctaaaaataaataaagaagaaagtgatgacaactgtgggggtggcacaatagtatgtagtagtaacagtaataaaatagtaattctgctgacaatatgacataattaaaaagaaataactacaactagaatgtctgaacacttgatgaattcatgtaccaaaatatgtgtaaagaacttccagttccaaaatgatgacatagaagcaagctggcttcactcctctccacagaaaacagaaacaaatgtacagaactgagattatcacagcaatatcccagaactcaaatatgaggacaagacagttcccaaagtcacagagaagtgaaaatctccgagcagatggtaagaaaattggactttcatatccacaatgcccatctccccaatatattcagcaccacgcttgtggaaaatattttcctgacccttgatttctgcactggaaaagtgcgattgaagtggacagtttcccgaccgtcttaggttacctggcaggagacctttacctgcctcaacccacaggaagcatcaggagtgcccgaagggctctatctctgtgaggacatccagagacaatgtggggagatgggactaccatcaccagccctggaaattctgctctgtaactcagtaaaaggagatgccaaatcagagtggctgttcagcagcaccacactgtagtagttttgctccacaggtttcctgggcaccaatcctcagccagcctcctcacactaccaggatatcccctttggaacctcccctatttgggaaaggtggtattctgatagtttactggagacaaggcaaacctggacctgaggcaccatctagtgccaaaaaggaggcagtgacccagtgaattaaaaaaaatgaaagaaaatgaacagaaaaattacaaagaatctctatgcaaacatacctaagaaaaaccaaagcaagccagagaagactgcaataaataactaatccttcaatgcaaagacatagacatatatccataagaaatggagagaagagtaatatatgagaggatgctccaaaagaaaatatactaaagttgctgtttaataaattcagggaattaaaaataattcaaagatacatatccttgataatatgcaggacggtggtgtgtttgcagacatacaacttctttaaacagggaagtaggatcttctcaagctgacaaaagcaaggaaacagtgagtgaccctaacaagatggtgataggtgaactctatgaccaagaattcaaacagttttaaggaaactcatgatcaccaagatagtacataagataaattcagacatttctcaacagatttaacaaagagattaaaatggttcaagaaattaaaaaagaaatcttggatctgagaaatacatctgctgaagtgaaaaattcattagaggctctcaatagcaaactagatcagaggaaagcatcaacaaacttgagacaggctatttgaaaatacagagaggtggggataaaagaatgaaaacaagtgaagatcacctacaaggtatatagaaaactacctgaaaagacaaaatctaggaattattggtgttcaagaggaaggtaaacaagagcaagaggtagaaagctttttaaaagaaagattaacagaaaactttgtaaaatgtaagaaacagagaaatatccagatatagaaaggtcagagaagaccagatttgattaaaataagattattccaaggcatataacaatcaaattcttaaaggtcagtgacaaagagaggatcctaaaagcagcaagagaaaagaagcaaataacatatttaaaagcttcagtttgtttggcaacagtctactcaacagaaaccatacaagctaggaggaagtgggatgacattttcaaagtgctgaaataaaaaaacaaatgccatataaaagtactgcatacaataaagctatccttcaaatatgaaagagaaatgaagtccttcccagataaaaagctgaagtaatttaccactatgagacccatcttataagaaatactaaagagagttcttcaaactgcaagacataaaaaactaatgcacagaaagaaaacatttgaaagtaaacccactgataaattaagtacacagacaaacccagaatactctaatactgtaattgcagcatgcaatccactcatcacttcagtatgaagcccaaaagacaaatttatcaaaaacaatagtaggtacagcaacgtgttaagagatagacaacataaaaatatacaaattgagacgacataaagtcaaaatatggagaaatacagttaaattttagagttttttcattgtttctttgtttttggcaaccaagtacaataaccatatgatcatttcaatagatgctgaaaaagcatttgataaaattcaatatggctttattataaagtccctcaagaaactggatatagaaggtgcatacatcaaaataaaagccatgtatgacaaacctatggctaacattgtactgaactgggaaaaaatgaaagtctttcctggaagaactggaacaagacaaggatacccacttacacttttattcaacacaatactggaaatcctggtgaggcaatttgtcaagagaagaaataaagggcatccaaatcggaaagggataagtcaaattagccttgttaacagatgacatgctcttataattagaaaacctaaagactccaccaaaaaacctgttagaactgatgaacaaatttagtaaagttgcagaatacaaactcaatgtacagaaatcaatagcagttatatacaccaacagcaagcaatctgaaaagaaatcaagaaagtggtcccattaacaatagctacaaagaatataaaatacctaggaatcaatttaactaaaggagtaaaatatctatacaagtaaaactataaaatgctgatgaaagaaattgagtaagatacaaataaatggaaagatattccatgctcttggattagaagaattaatattattaaaatgacaattttacccaaagtaatttacagattcaatgtaatacatatcaaaagaccaattacattcttcacagaaatagaaaagtatttctaaaatttatatggaaccacaaaacacccagaatagctgaagcaatctgagtaaaaaaaagacaaagctggaggcattacactaccttacttcaaaatatagcacaaacctaaagaaaccaaatcaacatggtattggcataaaaacaaacacataaaccaatggaatagaatagagaacccagatataaatccatgcatttacagacaactcatttttaacaaaggaaccaagaacttgcaatgaggaaacagtctttttaataaatggcactgggaaaactagatatccatatgcagaagaatgatagaagagacagaagagatagacccctatctcttaccgcattcaagaatcaactcaaaatggattaaatacttaagtctgagacctgaaactgtaaaaccaatagaagaaagcattggggagatgctcccagacatgatctaggcaaaggcatttgtgtaagatctcaaaaacactggcaagagaagcaaaaacagaaaaatgggattacatcaggctaaaaagcttctgcacaacaaaggaaacaatcaacaaagtgaatagacatgccatagaatgggagaaaatacttgcaaactgtctatctgacaatgaattaataactgggatatataaatagcttaaacaactcaaaagcaaaaaacaaaaacaaaacatctgattaaaaatgggaaaatgatctgaataggcatttatattgcctattgcctattcagaagacatacaaatggccaacaggtatatgaaaaaatgttcatcatcactaaagagatgagaattgcaactcaaaaccataatgaaatattatgtcacccagataaaatggctttgataaaataaaaaagcaggaaataatggatgctggtgaagatgtggagaaaggggaactctatttacactgttggtgggaatgtaaatttgtacagccactatagaatattgtatgggggttcctcatgaaactaaaaattgaactactgtataatgtagcaattcactactgggtgtatatccaaaagaaaggaaaacaatatattgaaaagacacctgtactcccatgtttattgcagtgctgttcacagtagccaaaatatgaaatcaacctaagtgcccatcatgaatgaatggataaagaaaatgtggtacatatacacaatggactcttattcagccataaaaaagacttaactcctattatttacagcaacatggatggaactggaggtcattatgttaagtaaaataagtcaggcatagaaagacaaacattgcatgttctctttcatatgtgggagataaaaaagtgaacctcatgaaggtagagagtagattggtgattaccagaggcctgagagggtcatggggagagggagaggaagaatagattgattaatggatataaatttacagtttcaatgaagagataagacctagtatttgatagatcagtaaggtgatttatagtttacaatatcttttacatatttcacaataggtagaagggaataatttaaatgttgttagcataaagaaaagacaactatttaaggtgatggatatgccagttacattgatttgctctttacaaattatatgaatgtattaaattctcacatggaccctgaaatatgtacatctattatgtattgattaaaatatatttttttaaactccaggcttccccaagattgtaatccacctgtaatttaactgactgctagtaaagcctgttactttcagaggaaaacaattcaacctagagactttgcaaagtataatccacaatgttgtgtgtatgtgggctgtgtgtgtgtgtgaaggaatgagaaaatgtaacccaaacatttgagagagaaaaaaatgtgtgtagacatggtgacttttatcagaagttgtattaaggtatcttaaatttcagttcctattactttaaaatctaaaaaaaactataacagttatttcatgaacaaatctaccaaaaaaaattcattcaaatatttgcaatctgtttatgtttatgcatgagtgcccaaaagtatcttcagctctttttctccaatatttaacatttattcctgggattgaagaatgttccttctattttactcttaaacatcaaagcaatgaaactattaatcccgctaataatgatgcatatttctcaaagatgcctttcattttcagatcagcaaccaaaggagtttcaattgtctctccagttggctctaatgagagatgtacagatgttaaacccaatactcttcttaatcattttccttcgtgtacttgattaaatcctcaaaagcaaactgttcatgttcttgccgaaaatataggcggtctcacttaacagttatgttgcacaagaaagggaagttataatggcatggaacgtgctctacgtggtattttctagactttactagttcacgagcttttgtggataagtcaaactcttgaatgtcacttaaatgtaatcttttctgtagttgattatgcagagaatacaaaaggtatctgcagaatgtggaattaattttgaaagtttgataaaaacttcagaataatagctgtggctgtacaagtcatctatgaaactgttctctcataggtgacattaatttcctatctacagagttttattactgaatgtgttatgtttgtacccccacaaaactgaaataatagttttctttttttagcagtctatgaaaatgttgaggtttatcttgactgccgctttttaacataaatatttgggcttcattgaattcctaatatgtgatgtcacttggaattctgatagggtccagtaatttggcctgcaaagacatattttaccttaaaatgaaagggatagttgaaatgttattttacacgatagcaaaaaagcatccaacataagttgtgagatttttattgcttaacttttgaaatagaaggacaaggttcttatgtgcttgctttattccaaagtatatatgggaatgctaatgctttatatgtaaaatgtacgctacacatatttgtgattagttaatttttatggctagaaattctagaatcataaaaaagaactaatcttgaatgtcagagcttcacctatttttttaaaaacaatgagaacaaaaaaatcattataatttttatatttaccttgtgtttcacaaaaaggaggttttctttgctgtgctacactgcaagaatatgtcatgttcaaatctctggggctttattaaaaactttaactactgtcttcttatagagattattaagcaaatactaaagatagcatagatgtgtggtctaggcagtatttttctggcaagtagacctaagtgcagaatttaagttctgtaacattaacctgagactaaatcattttattcagggttgtctcctctgtgaacagctttatgttatgacctcatttgctacagcaaatgaaatattaatagatcattgaaaatgcagtaaagttttgatcagatgttataccttcattgtataccaaaccctgcctctcataaaaactttctacttgggtttaaattgaaattatcactcaattttttaaaatcaaacattttctttaagaacatgacaatgtaaacatatttcttacgggaatctttaagttctatatttttcaccaaaaatcatttcagaccatgctagttaaagagttattgaaaaaaaaaagaatctatttagatgagtcaaaaaattaagcaaagtatgttttaaataagttagtgactataaaatttctcaatttgggcatttattttgactgcaagtaacaaaacacctgacaaaagagacttaagtaaatagctctagatatatagttgactcttgaacaatgcaagggttaggactgctgatccccacccagtcgaaaatctgcatataacttttgactgtcccaaaatttaactactaatagcctactgttgaccagaagccttaatgataacataaaaaactgattaaaacatagtttgcatatatatttatactatattcttaccataagtaagctaaagaaaagaaaatctcattaagaaaatcataaggaagagaaaatatatttactattcattaagtggaagtggatcatcataaaagtattcatcctcattatcattatattgagtaagctaagtaggagaagaaagaggaaaggttggccttgctgtctcataagtggcagaggtggaagaaaatctacatgtaagtggatctgcacagttcaaatttattttgttcaagagtccgctgtggatagttgttggcattggtgaaccaatgccaaatataatggcggcatctttgtgattgttttggccttttcaaataactgaaagatgattgctgaagttgtagacatcatgtttagcggaaagaaagagaaaaggagaaggtggcagctctttcaagaaagctaaaatttcctaggaacctccataggagtcccatcatggtgttcccgtggcatctctgagcagttatgtttcatatcacaactcctaggtaaagtaaggcaaaggagaagcaggttagaagtaggcattaagttgccacatgttctaattgtcaccttgtttaccaagtcatgtatgtcttatctttgcttaccaaacaaaatgctctgattttcttgattagccatagtgacacttgcttcttgtctttgaaactgaaagtaataaaccacctcacgccatgtgttattcttccaaaagctaacataattttgattgatttgaaaatatatgatttcatatataaacatatataattatatatatatattagtatctattgctgccactttttacttaagactgatagcatcaatgttaaatagtgtcttttcagaagtattgattattctctctgttgcagatctcttcaaattgattgggtgtctccacggaagccaaatggcatcattcttggatatgatctcctatggaaaacatggtatccatgcgctaaaactcaaaagttagtgcaggatcagagtgatgagctctgcaaggcagtgaggtgtcaaaaacctgaatctatctgtggacacatttgctattcttctgaagctaaggtaagtcttttctaactaatcagtgaaccatgtttttctcactcaagactccaagtgaaattattagcttctcacaccatgatgtattatgatcaatatttccactactctatgaagaagactccacggaaaagaaaggatgcttacaaaaatcactatcaccctcatgagcactttagccttcccattttttattatcttcacaagaaatataaacttattagaatagggtacatcccaaattttatttgattgagtgacttaaaattttctttacaacagatcttttcagctacaaataggtgtttgtttatatggcactgatgagtaactgtgaggaggacattttatgatttgtcagaaatattttagcattatagtcatttgtagattaatgttcatattagatgcggtttagaaatcagatcaataatacagccagacagaggagtttgtaaatgacttttattgacaaacaacacaaaatccttagtttgaaggtagaattttatataatgaaataatgttcctatttggcaacaacagcatcacacattcaatggctaaagctactactaaatttataagatttactgcaaaagaacaccataattaagaaagtgagttactgaagcaatatggatcaaaatacaaattattatggctgacacaaatttagcaggagttatcatctaagaaatgcataaagccagcagttactaactgtgcattttttgatacttagactctaaaattatcattatgcctacatttgacatcattttatgccattaagtatgcacatatttaaatacacacatctgatgaacatatttgtataaaattaaatttgggatttctgagaagaaaaatactaaaataaatttgcccattaaacatatcctccacttaagaaaaacttgggaaaatgttggcaaaatacggaattcacttctcaatttttttctttgcttctattattttaatatttattatctgttacgaagtggacaaagagagaatagttgtataggcatacgaataaatgatttaaagtttgtggagtgcagaaaacaatgtgttccatcaaagtaaaaactgattctggccagaaactgtcatagtagtttaggtgtgtataatggatttgataagtttcaaccctataactttagtggcaaaatcaaagctaagtagagtaaaactagtaaagataatgtttccatttaagtttattctaaaagatcaaaaggtggatgttcttaaaatgttcatattaaattagaatatacctgagatagggtgaagaaaaagtaatgggatgaagaaaaatattaataaagtattaacagaataatatttacctatgtttaggctaaattatttataaaattactcctacctttctttatgctgtgatttcagaaaccgctttttgtaacttttaaaaatttactgaagctttgtaccaaataagtgactggttggtgtaacattcctaaattcagtgaatgacaaagaaccggttagtttaattttaaatcaatttaaaaatgatttagacaaatctactctacaaaaaaaaaaaaatcatacgggtcaccttttatagaaaataaatgtaaattgatgaatagggaagcaaaagttaggctttagaaaacaggcgtgtgcaaatctcaccacatagtcttgaaaagaaacatcacatttggttattcttataatgcaaatgtcataccttattacactaaaacgagacacactatttaatgatgccttaaacaaagtcttatttttattgttgagcttaaagaggcaacacaggtattgcggtaaaagagaataaaggatgtcagttaaatttcaaaaaaaaaattgtaaagttcagtttgggactaggtactaatacacatttcctagcatgaaagattggagagaagtagaaaagagacttgtattgcgggtttaaaagctttttggctaaatcactgtaaacatcaatgtttcccaaaatacttaaacaagctttaccataagattacagccatggttcacaaatcccagtgaacgtaagacctgggggaattgttaaaacctaggatttcatagctctagtcccagagattctgattcagtaggtttagatttggctgtgaaaatttgcatttctaaacatgttcccaggtgtcttagttcgttttcacagtgctataaagaattacctgagactgggtaatttatgaagaaaagaggtttgactcacagttctgcagacttaacaggaagcatgactgggaggcctcaggaaacttacaatcatggcggaaggtgaaggggaagcaaggaccttcttcatgtgatggcaggagggagagagagcgaaggggagagctgccacactcttttaaaccatcaaatctcgtgagaactcactcgcctttagacctacaataaaagtctctttcctacttctctccaatctttcatgctagaaaatatatattcatacctagccccaaatgaaatttacaattttttaaatttaattaacttcttctgttgtctttcactgcaatacctgtgttgcctctttaatcccaacaataagactttgtttaaggcattattaaaattttatataataaaaaatgtatatatttaaatatatctatttttattataaaattttatataataaaagatctatatcttatgtatatatacatatgtgtatgtgtaagatataagatatacatcttatatcttttattatataaaattaaaattttatataataaaataaaagatataaaattaaaattttatataattaaatacatattatattatatagtattataatagagcacaaagcatggttgaagacttcaaaaaagctgcattctatcaaataacatttataaaattcgaatgatcctggaaaatacatttttaaaccaacgaaatatgagtaatatggtctcagatcttctatgccttacaagaaaataattatattacatgagatacagtggtataacactcttaactaaactgatatttctttaaaactgttttcaaactttcaggtttgttgtaacggagtgctctataaccccaagcctggacatcgctgttgtgaagaaaagtatatcccgtttgttctgaattctactggagtttgttgtggtggccgaatacaggaggcacaaccaaatcatcagtgctgctctgggtattacgctagaattctaccaggtgagggttatttccaggtgtactcaaaaactatgggaacctgaaaacataaacacgtggttcatgtcagtgaactatttcaaacacctccctctcaacaaaaattgaaccataaacacatagccaatggcctgctctaaatattgtttcttccttctgctttgttaaaatataagcaaggctaaatattagaaaacgagagaacagaaggaatttacaatatctactacagaaagaaataaatctggagatctggctaactccttttatcttgtggctttttttattaacatgactatatattttcactattaaatatgtgaattgctgactgttccaccccatgaagctgttccccacttcctccatttctaatctgaactacacatgcattgttcttggatagatcgcaactgcaaatttcatttgtctgagaattctaggccactggcaatattctctcatcataagtcaggcaagggaaggaagaatgctgcaaagggtagcaaactggattttttccttcatccctttttagtattagccaacttagctagccattttgctccaaatttcaactacataaaacaatgcctagtgaatataattgggaatgatgctaataataactgccatttttaaagtaccaagtctctcgcaggctctgtattgaagactttacatgggataccttatagaatcttcacaactccaggaaatttgtattatacaaggcagtttacaagtaaggaaactgttttagagaggatcaataacatatccagattcacagatgtgcatagaagtgaaagaactaaaatgtgaatataagtatgtctctcctaaatctatgctcttttgtgtactttactgcctctttaaccaaaaagcatcaacctcttttgacaatttttttaaaaggactatttaagacttctaaacttcttcattactaccactgtcagttacaatttatcctgcaaaagtaattgagaatacaaaagtaattgagaatacaaacttttttctactacttaagtttgatactgatatcttctttaaagagcaggaaatggatataggagaaagacaagaaagccaagttttttggaggccataggaaagctgaatactttgagatatctagtttagggtgaaatttatgcccaacgtctggttcctgtaaattatgttcagtataactatatccatccaaggcatgtgaaatgagacactgtctaacccagtgtctgttttgcaaaatactggagcaaatatagaaggcgtgcaatcacctgatgggttcatcttgcccattgcacagatagagccaatttaccaaaacagtggtattgcaacagagaaagagcttaataaatgcagagccagctaagcagaacaggaggttttactcaaaacagtctcccagaaaattcaaaacctagggtctgtctgggcacggtggctcatgcctgtaatcccagcactttgggaggctgaggcgggtggatcacctgaagtcgggagatcaagaccagcctggccaacatggctaaaccccatctcttgtaaaaaatacaaaaaattaactgggcgtgtggcaggctcctgtaatcccagcttctcgggaggctgaagcaggagaattgcttgaatctgggaggcagaggttgcggtgagccgagatggtgccactgcactccaacctgggcaacagagtaagactctgtctcaaaaaaaaaaaaaaaaaaaaaccctaggggtttttttggttggttttttgtttgtttttgttttttgtttgtttttttatttgtttgtttgttttgagatggagttttgctcttgttgcccaggctggagtgcaatggcgtgatctccggctcactgcaacctccacctcccaggttcaagcgattctcctgcctcagcctcccaagtagctggaattacaggcatgtgccaccacacccggctaattttgtattttcagtagagacaggctttctccatgttggtcagggtggtctcgaactcccaacctcaaatgtctgcccaccttggcctcccaaagtgctgggattacaggtgtgagacaccacacctggcccagcctagggttttttttaggatagtgcagtaggcatagggctagggaatgaggaatgcttattggttggggataaaattatagggagtcagagctgtcttcttgtccttagtcagttcctggatggggactataggatcagatgagccagtttactggtctgggtgatactagctggtccctcagaataaagagtgtgaaaaatagctggtccctcagaataaagagtgtgaaaaatacgttgaacaccaatcttaggttttacaatagtgatgttatctatggaagcagttgggaaggttaggaatcatgtggcctctggtgccatgaacacctaagccgtagttccttgtggctaatttgttaattttataaaggtgctctgccccccaagcaaggagcaagtttgtttcaggaaaggactatcatcagtgtttcgaagttaaactaaacacctctcatagttatcttggcctatgcccaggaatggacagggtagcttgtaggctagaagcaagatggaattggttaggtcacatttctttcactgtcataattttccagtgtcaggattttcttactgtcataatttttgcaaaggtggtttcaggtgtcctgattaaatactgctcaagttttctcaaggcagagaaccttcactcattatttttccttataattaatagaaaaaaaaagtttgtatagcagtgctgttatttcttattctctatcaaaaatatttcaaaattgaataagttctagtaaaccagattttccacttaagaaaaagtaaaaatatatatggaaataaggattttgtagaaaactgttaaacttcttcatactacagctcacgatgtcaacaatggatcaaatactgttaaatgctttactttctcgaagtaacttaaatttggggagttttcatgtatgattcatatctgcccttgattacaaatcattgctataaaattataattacagtgatcagatggacgttttgtgttgttcaattcctaccattcttcacaccagtagaccaagttgatcatggaactaagtaatagtgttttcatttccacatcacattaaaatttttatgttatgatttgcaacaaactattcaaactctacaaaatatcctctgtcccttaaaactaatgaaaaattcttagttacatcttcactgctgctaactcaggagactggcctgtgactttctcaatgctaacataagtagtcagattttgaaccgacagcacaatctacttttgttaggtttcaaaataaaatttaacatttttcttaaaaatgaaataactcatggaagctcagaagttgtcattgatattatataagcctttaataattaatttttagaccaaggatttaaaaaatatgtattgtctgtatgtataaatacatgtttctgcacacctaaagcattttaatatctaccaaaccattgagcatgccccaaattttgattcttttttaaatagttcatttttcatagcattagaatgcataccctggtgtcaagaaaaaaggaaaaaagcaatctcatgaaataatcaaagagtgttttgctccaatcattaatcccactgtacctaaatgaagagattattttgtgacctctgtcctcagccccgtggtctttgttagctagtttaacactggttacactgagggggaaaaaagcgcaatggtcccaaatcctgttgcatctaaatgtgatttaaatctggtcactagtctgccagttcaaggccaagatgggtataggcattttgatatttatggattagcctgaaatattggtaaatacgtactttattttttttctcatgactttcttccataacaccccataacaaacagcagaagaggaaagaatgctcatttctctcccttttttaataaatatgctaataaccccaagtaaatgttaatgtgggtcattctttgataagaataacaattaactgttagactgcatggtagtttttagagagaaaacattttcaagcctggcctgaaatagattcattttgagaggttaatgagaaggtgactgatccttgtatcttatgtctaatagcccctttttgaggaaaaaaaaatagttttattttttattgatataatccacatctttttttttttgaagacttttcttctgtcagtaactaaataagattctgagggattcagaaagacatagctaaaatatctaaaccaattaacatttattatgctcaaaagaggctttaaaaaaaagtattggctttcgccatgtagatgtgtatactatgtttcctctaagctcaccattgtcctgagtggtgtttaattaactgttgttgccctgtaccatgggatacattatcttaaagtttaccatagagggacattatgttctttgactgtgaagacaaaaaatatggcaactacatttcagacgaaatagaattattttacccaggggaagataacaaatacagtaactttactgtttacaataagctcgttgctccttcattggtctctggtagcatcatcatggaaacttttactaagttccctttttcttagagataccatattataggatcctttcaaagataattgactaagccaactgtctcctgaattctagaaattcatattttgagaaaatcctgagtatgtcttgatccggtcctggatatttaccctagagaaaagcaaatttatgtttacacaaaaacctgtacatgagggtttacagcagctgtaatcattactgccaaaacctggaaacaattcaaatgtccctaagtgagtaaatggacaaatgtggaacaaaggaatactatgtagcaataaaaaagaacaaagtattgataagtgccaagaagatatcaagcccagtgaaagaagccagtctcaaaaagctaccaactgtgagactgcatttacatgacatactatacaagacaaaccatagttttggagaaaaaagttgacaattgccaagggtaatggatgggaagggaatgtgactatacagggatagcgtgagggtgttctgtgggggtgatgaaactcttttgtatcctgatggtgtttcttcattaaaattcatggaagtgtgcacccaaaaaaactaatggtcctgaataatatttttaaatgaaatatttttaaaacactatttccattttacacataggaaaaatgggacatagaaacatgaccaagacactcagctagtcaaaataggaattttcatggttaaattttaggttgagctcctagagatggtgtgttttataataatgtgatgactgtgtatgagtgacttaatatatttttctcatatgttagtagaacagtaagatagcaaatatatttccattaaaattacaatgaacatccctatctttaaaagaaagcaaaaatgtcttagtcagtgatgactatttcaagtaatattttacatgatcacattcttatgaaagcataagttttgtgtagtgtttccgtggtttgatgctgaataattagtgaataagatattggttctggagtcaaactgcctggctccatatcccatttctttcacctcttagttgtttgaccttcattaagtaactttaggaatattagcagggtattaatgtttctgatgtccattgggctgctgagttagaatactcaaagctaaccctatcttttatatctaaatagaaaaaaaatgtttagtaattgaggagcatatgagtaaagagggctaacaggcctcctttaaatgacaaagtttctaatgaatctttccagagcaaggactcaggggtgtccactttcatcagatcatgtaaagggatagccagttcccaaaagctaagattcaaacatctaatgacctttgagatcctatgaaacaaaggatccttgttgatcctatgaggccaagcaattctctaagttgacttttagcaactagccagggaaagtcatgaagagcttccaaactttgaagagaaaaagactttccattttgcaaaatgtcacagcctagaatttaggtcctagaaaaagcattttgttctgacaaaattgacatttagagactttatgtcgattgtatgctaccactattgacaaatagagggaatcaatttttcaagtctatctggagaacgtgacagatgatcattcacatattgcacaacagttgaatcttataggggaaattaaatatcgctcagtttgtttcctattgctgctataaatcatgaccagacacttcgtggcttaaaaccacacaaacttactttatacatccaaatatcaaaagtttgaaatgggtctcattgaactaaaactaagaagttaacaagagctgcattcccttctggaggagagaatccattttcttgccttttccaccttgcagaggctgctcacattctttggcttgtggaccccttccattttccaggccagcaatgaccagttgagcctttctcacttcatattattaaacttaatcacatctgttgtcttcattcccctttgccatgtaacataacatagtcacaggttccagggattaggatgtggacatcttagggaggccatgttgtgcttaccatggtaaggtaatggttaagcagttgtgagaattaagaaagcattgtcgtaaactcttggggaataactgtcacaagtgaaacaaaaaaagatactgtgagcctgagtgcaagaatatatgaaaaaaatgctaagtatagatttgctataaattaagcagctgcctcagggagtggcagtaggatgatattagggttgggaactacagggaaatgggggagtgcaatcttgttaatgacacttaaatcttgtacaaagtggtacacaagtcttttatcattttgatagagtgaacagtgaactacaaggactggtacaggggataatggggtgttatgccaagcgaggtaactttctagaggtatgtagatacaatggaccaagttattaaatattgttctttttagtagattttgggacagtttcaagaaatgcatagccagattgatagacatctttaaggggttagcatcctgtatgaatcccacatctgagcagtttttgccccagaggatcttggagacacattcaaagtcagagatgttgataacaaaggcatcaggtaattagctggtgctaccaccaaattataggccaggcattcttctcctgggagttacagaaagagactttcaggtgcacatttaatgctggtatctcatttacaaagtggatctcttctcaacagatgcactgaagtggaattactaaacaaaaaatatgttgattcaagagaaagaaaagaaaaataaaggcagaatctgaaaattatttgatatgtgtaccgctgagacatttggttattcctagaaagggataatggaaaattagaagggtttttgatagataatatacctaccaccagtatcaatcttctatttttacaattgcatagaaatttctcactttctatgtcaagggcagttatggatagatgagagcagctactttcacagagaggtgctgttttgtcagtttgtccttttttttttttttttttgattgtgtctttctaagatacactaataaaggcaaagtaggtgttctcccagtgtcccttacaatattgaaagttgtttttgtgcagactagacatagaggtgccctcattcttggctttatctaattgcttaatcccaaaagctgttaatgtggtctgaattttttttctttttttctgagccaaagtatcttctaagtgcttagcaagctcttgtaatttagaaggaagggacaatctactgtcttatcttctgttttatgggaagttatgataccttcttcactgatctttagagtattctggaaggtggtagttaagtgatctctgaagccaggcatggatttattttttccttgtttacaggacttttttgtggtaaagtatacaccacataaaatttatcattttaaccattttttaagcacacaattcagtggcattgagtgcatttgcattgttgtacaatcattaccaccatccatctctagagctcttttatcttctcaagctcagactctgtttccattaagcactaactttccactccctgttatcttcaacccctggaaaccaccattctgtttttggtctctatgaatttgactactctaggtacctaatataattggaatcatacaatatttgtctttttgtgtctggcttatttcacttagtgcattttctttcttttttttttattatactttaagttttagggtacatgtgcacaacgtgcaggttagttacatatatatacatgtgccatgttggtatgttgcacccattaactcgtcatttaacattaggtatatctcctaatcctatccctcccccatctccccaccccacaacaggcccctgtgtgtaatgttccccttcctgtgtccatgtgttctcattgttcaattcccacctatgagtgacaacatacggtgtttggttctttgtccttgcgatagtttgccgagaatgacggtttccagcttcatccatgtccctacaaagaacatgaactcatcattttttatggctgcatagtattccatggtgtatatgtgccacattttcttaatcctgtctatcattgttggacatttgggttggttccaagtctttgctattgtgaatagtgccgcaataaacatacgtgtgcatgtgtctttatagcagcatgatttacaatcctttgagtatgtacccagtaatgggatggctgggtcaaatggtatttctagttcaagatccctgaggaatcgccacactgacttccacaatggttgaactagtttacagtcccactaacagtgtgaaagtgttcctatttctccacatcctctccagcacctgttgtttcctgactttttaatgatcgccattctaactggtgtgagatagtatctcattgtggttttgacttgcatttctctgatgcccagtgatgatgagcattttttcatgtatcttttgtctgcataaatgtcttcttttgagaagtgtctgttcatatccttcacccactttttgatggggttgtttgttttttcttgtaaatttgtttgagttcattgtagattctggatattagccctttgtcagatgagtagattgcaaaagttttctcccattctgtaggttgcctgttcactctgatggtagttttttttgctgtgcagaagctcttgagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttgatccatcttgaattgatttttgtataaggtgtaaggaagggatccagtttcagctttctacatatggctagccagttttcccagcaccatttattaaatagggaatccttttcccatttcttgtttttgtcaggtttgtcaaagatcagatagttgtagatatgtggcattatttctgagggctctgttctgttcctttggtttatatctctgttttggtaccagtaccatgctgttttggttactgtagccttgtagtctagtttgaagtcaggtagcgtgatgcctccagcttttttcttttggcttaggattgacttggcagtgtgggctcttttttgggtccatatgaattttaaagtagttttttccaattctgtgaagaaagtcattggtagcttgatggggatggcattgaatctgtaaattaccttgggcggtatggccattttcgtgatattgattcttcctacccatgagcatggaatgttcttccatttgtttgtatcctcttttatttcattgagcagtgctttgtagttctccttgaagaggtccttcacatcccttgtaagttggattcctaggtattttattctctttgaagcaattgtgaatgggagttcactcatgatttggctctctacttgtctgttattggtgtataagaatgcttgtgatttttgcacattgatgttgtatcctgaggctttgctgaagttgcctatcagcttaaggagattttgggctgagatgatggggttttctagatatacaatcatgtcatctgcaaacagggacaatttgacttcctcttttcctaattgaataccttttatttccttctcctgcctggttgccctggccagaacttccaaccctatgttgaataggagtggtgagagagggcatccctgtcttgtgcccgttttcaaagggaatgcttccagtttttgcccattcagtatgatattggttgtgggtttgtcatagatagctcttattattttgagatacatcccatcaatacctaatttattgagagtttttagcatgaagcgttgttgaattttgtcaaaggccttttctgcatctattgacataatcatgtggtttttgtcgctggttctgtttatatgctggattatgtttattgatttgtgtatgttcccattcatgttgtcgtacgtgtcaggattttattcctttttaaggtcgaataatgtctcattgtatgtatataacacttttgtattcatttattcatcagcggacattggggttatttctgcctagtgactattatggttaaagctgccataaacattgatgtagaaatgtacaaatttctgttcaatctcctgttttcaattcttttgggtttatacccagaagtggaattgctggatcatatggtaattctatgtttaattttcatgttaagaactgccatactgttttgtggaacattttaacattttatattcccaacaacgcataagtgtgccaatttctccatattcttactgtttattattttatgttttttataactatcctaatgagtatcaagtggtatctcattgtggttttgatttgcatttccctacttattactaatattgagtatattttcatgtgtttattggctatttgtatgtcttctttggaaaaaagtgtctattaaagttatttgcccatttaaaaaataaggtctttgtttcatgtttttgagttatagaagttctttatacattctggatactacttccttatcagatatataattttaatatattttctcatgagttgccttttcactttgttgacagtgttctttgatgccaaaaagttattaatattaattatgatgaatccaattcatcttttttccttattgcttctgctttcagtgtcatagccaagaaatcattggcagacccaatgtcatgaaatttcccctttgctttcgtctaagaattgtaagttttagcttttacatctagatctttgatccattttgagttagttttggtatatggtataaagtaagggttcaatatcattctttggcatgtggatattcaacttttccaacattctttaaaaaaaaaaaaaggtcctttcctcattaaatggtcttggcacttttgttgaaaatcatttgcccatatatgcaagggttcatttttaggatctctgttctatcccattggtctatgtgtctgtctttgtaccagtaacacacttttgattactgtaactttgtagtaagttttgaaatcagaaagtgggagatctccaactttgttctttttcaatgttgttttgactatttgcagttttttgagattccatgtgaattttataatggcttcttctgcttctgcaaaaagcattgggattttgatagggattgaattgattctgtagatcacttgagcagtactggcaccttaacaacattaaggctcccagtccataaacatgggatgttcttccatttggttatcttctttaatttctttcaacaacattttgtagtatttcagtctttcgctttcttggtaagctcattcttaagtctttctttttttgatgttattgtaaatgaaattatcttattaattttattttcatgttgttcattcttagtgtatagaaacatacctagtttttctatgctgactttgtatcttgatactgtgctgaattgtttattagttgtaacaggttttttttttttttagaatctttatagttttctctatatgatatcatgttgtctgagaacacatagttttgcttcttccctttcaatttagatgccttttatttttttctcttgcctattgctctagccataatatccaatattatgtagaatacaagtggcaaagggtggcaaccttttcttgtttctgattttagaggaaaagttttccgtctttcactgttgagtatgacattaggtataggtttttctcatatactcttgattatgttgaagtagttttcatctattcctattttcttgagtggatttataatgaaagagattgaattttgtcaaatatttgttctacatcaactgagataatcatgtgtttcttttttttcccctttgttctattgatataatgtgttacattgattaaattttcatatattgacccatcctggtattccagggatatatcccgcttggtcatgttgcagaatcattttgatgtgcttttgaattcagtttgctagtattttgttgaagatttttgcatcaatattcatgagagctattgattttaacttttttcttgtggtttctttggtaagttgtatgtttctagtaatttgctcatttcatctagtgagatggatttttggccaataaatttggaaagaaaagatctcaaggatagctgctgagagttattgtcttattatttatactccttatatatctatgtttaattaaatattgtcccatatttttatatcattttggtaaacagtacatcttgcttttactaaacaaattttaggatatccagggctcaccaaaaggtgaactaattgagaagaagtccaggactataaatccctaaggcagtcctaaattcttcagtggatttgtgccatttcttaagaaagcttgacaagtcattaattggattatagaaatcttacctggaccatggttgaaggccataagacccatcagattggtcatcatactcacataccttataagatataatgaagagatgttgtccaggggaaaagatatgttcaagaaagaacggtagagaaaagggaagaaggtctgttgaaggtgtaggaagaagaggaggagcaggacaaaagagagaaggaagtcagggttccgaaggccacgagggaagacaaccacagtggggtcatgagatagagaagagaaatgaagcttggatttcagatccaccaagtttttattagttcttttgaaggtatccttaagggaagccatttacaaaatcttctgtcctttagagttgtctttataccaaacaaacaaacaagctaactcttggtatttagagtatttgagtcctttgattttaaggtaccaggcaaaagattatctaattctgttttttgttttttttgtttgtttgtttttgttttttagatatgcccaggctggagtgcagtgaaacaatcctggctcactgcgcactctgcctcccgcctcccgggttcaagcaattctcgtgcctcagcctctcgagtaggtgggactacaggcatgcaccaccaagcctggataatttttttatttttagtagagatggggtttcaccatgttggccaggctggtcttgaactcctggcctcaagttatccacccacctaggcctcccaaagtgttgggattacaggtgtaaagcaccacacctggtggattatcttattcttatcccaaatttcccagactgtcatgtgaagagaaatgtagtaaaattcagtgtgtgacatagcccagagaagtactagcacactgacttaaatacagtattttttacctcctctcatgtaattaaccttcccaatgggagtattttgtttggttgaacaaatatagtttggtcaaggaaattatagtcataagcaatataaatttatcaatagttggtttttgaatccactctacgttccaaaagaaaattacacagaacaaaaaagtattcctagatgtttttctataatgccacatagtccatgtcaccagacctgatggtgaggaaatagacaacatagacttacctgtaagttgccatgtgtgtatctgatctgacacacgtttatacacaaaaactttggagtcatttggaaattttgcaactccaatatgatattattctctttagtaattctgtcaatcagttgggatctgcaagatgattgtgataaaagttaattgttagtcatagcatatttttttaactgatgtaatgattattattgtcctaaattgacaggtgaagtatgctgtccagatgaacagcacaatcgggtttctgttggcattggtgattcctgctgtggcagaatgccgtactccacctcaggaaaccagatttgctgtgctgggaggcttcatgatggccatggccagaagtgctgtggcagacagattgtgagcaacgatttagagtgttgtggtggagaagaaggagtggtgtacaatcgccttccaggtaaggggcccaggtctacctttcagtagatggaggatctgagaagcagagagagtgagaaatttgccctagaaataaaacaaataagtaattaaagctcacattggttatatctaatgcaataattaggaacatattgtttaacacataacaatgtaatctcccaatttttacatgtatctcatgtatttcataaaaacgcatcaattttttttcctcttgaaaaggtcatgtcctccaaaaaaaattccacacatgaatgcattggttatgaatgaaaagaatatttcctagcaaatagtatacaaaattattataatgatattttgttataattcttttactcccttattctactgtattaagctaacactaatataaataacaataagtatcattgaatgaatactaacagacactgtgccaatattttatatattattacctcaaataatcttcacaataatcttacatgataggtactatcaattatctgcattttaaaaatgaagaaactgaagttcagacattagatattagacattatcttgctaaataccacacagtcagatccagattttgggaagcctgacatttatgttattggaggtggggcttttaaagacaagaaaattaaaatatgaagttaatgttcacagtatcttcaccaggcatagattccatctcaagaagccactttctttgctcctccctaagaagcaactcctcatctgttagttttatgattgcagcaattcagttacctcttcaggcttcacttctcattccagttctcttgctatttccactgcatctgcagttatttttcccattttgagtctaaaaccccttagtcatccatgagggttggaatcaacttcctctaaactcctgttaatgttgatattttgacttcttcccatgaatcatgaatattcttaattgcatctagaatggtgaatcctttccaggttttcaatttactttgtccagatccatcagaggaattactatctatggcagctatagccttacaaaatgtatttttaaataataaaactggaaagtcaaaatgactacttgacctatgctgtgttaataggcatgtaaacattaattttcttgtctatttccatcagagctcttgagtgaccagatgaattgtcagtgagtattaatattttaaaagaaatatcttttttctgagcagtaggtctcaataatgagcttaaaatacatagtaaaccatattgtaaacagatatgtaatcatacagcctttttgttccatttacaagcacaagcagaatagatttagcataattattaagggccctagagtttttgcagtggtcaatgagcatgggcttccacttaaagtcaccagctgctttagccccccagcaggagagtcaacctgtcctttgaaactttgaaaccaggcgttgactttttccctctacctatgaaagctctagttggcatcttcttccagtacaaggctatttcatctacaatgaagatctgttgtttagtgtagccaccttcatcagtgatcttacctaggtgttctgggtaacttgaggcagcagtttctacatcagcacttgctgcttcaccttgcacttttatgttatgaagatggctttttttcttaaacctcatgaaccaacttctgttagctttcatctattcttctgcagcttcctcatctctctcagccttcatagaattaaagagagtaagagccttgcctggactaggctttggcctaagggactattgtgactgatttgatcttctatccagaccactcaaagtgtcttcatatcagcaataaggctgtttcacttattcataagtgaatgataagtgaaatagaaatcttacctggaccacggttgaaggccataagacccacaagatttgtcatcattctcacataccttataagatataataaagagatactgtccaggggaaaagatatgttcaagaaggaatggtacagaaaagagaagaaggtctgttgaaggtgtgggaggaagaggagcattttgattttcttcaagaactgttcctttgcatgcataactgggctaactgttgggcatgagaggtctagtttttggcctgtcttggctttccacatgccttcctcaataagcttaatcattcctagcttttgatttaaagtgagagacatgagactcttcctttcacttgaacacttagaggctattgtaaggtaattaattggcctaattttaatattgctgtgcctcagagaataggaaggcctgaggagagggagaaagataaaggaacggctggtctgtgaaacagtcagaacacacaggacgctcatcaactaagctttccgtcttatatgggcaaggttcatgacacgctaaaacaattaccatagtaacatcaaaggtcattgaccacaaatataaatataaaatataaaaattaaaaatataaaaatataacaaatataataataatgaaaaagtttaaaatattgtgagaatcatcaaaatgtgacagagacacgaagcgaacacgtgctattggaaaattggcaccaatagacttcttgatgcagggtggccacaaaacttcaatttgtaaaaaaatgcagtctctgcaaagtgcagtaaatcaaagcacaataacgtgaagtaagcctgtgatactaaactactatatgcctttttaactcttattctctcctatgtgtacagcagagcttttcagatgttacatggcatgatttgcaacagatcgaatgcagactcagaaagaaaattaaattgacttctcttaactaaacatttaaaaagcttgcaaaaatataacacaatgtcattcttctattttttatttgaaaaacatttattttcataaatatgttagaatgttatagatttattattttatgtctaaatgcattaataaatatttcaaaaatttctgccgtaagttttaacacagtacatatcaacaggtaaaacccatataaacaaaaggtatttggggtcctcaataattcgtaagcgtataaaaggatcctgagaccataatttgagaaccactgcttaaagtcatagtaacgtctactagaaaattatggcaactaattagttatcctgtactatgactaaccagttgaatacctcctcctcctttagatgaagtagctaataacaggtctattaaagatagaaccaaggtggcagggagggtgcaaaagtgttacctcctgtgtactctaatacatcagagtttaaaaatgacagcaaaatatttgattttagtgtgtttgttcatctgtagctttttaaaagaattagtcaactgctatactccgtcctttgttaaatatgtattatgtagtaaccatattcaagacatcattcttggtgctttgcaagtgtaaaaatggccaagattccgtttttatcctcaagaacttacaacctaatcaaggagaaaagtgcctacaaggttatacacagaccataagagagggatgaatgcatgcatattcttaagacggagagatcactccagtcaaggtaatgaagggggttgttccattggattggaatctcaaacagtgagtatgattttggcaggtgtggcttgagctaaactgtgaaattagcaatctgcaaaacacaaataatagcgtgtgctttggtttacaggaggtatacactctgtgtaaggaagaaaggagataaatctgagtaggcaaaaggatttgaacattatttagcactcagggaagagtcaatatgatgataagaactgtagtttaagattaaatttaggtgtcagaacaaatacaatagagaaggaaagagaagtcagaacacccctggcatgaagtaaaatacatctgttctaagaagtggaatggaggttaccgtccactaggacaatggttcttaacttgttttccttttgaatcttttggaagttacaaaccctcactctgaataatagtgcatggaatatacacaaaaatttgcctgtaattttatccacccttgaactccatccatgaactcaaatttcagaatcacttctttatttactccaagatgatgtcgcatgccagtcaaacatttcttacacaaatggtgacagccctcaactcttgcgaatcaagataagctctagagtttctcatggcattctacagctctgccaactctgataatcatagtggacttaaggaataatagttttacaaaggaaaaaatatatctttttattctcttgactttctttctgcaggttgcactgaaaatagacagattccacatgtatttttcctctctctgctgccgttcactcctgtagcccctaatgactgtgaccttaatgaccttccagaatatccatatggccctttttctcctcaacctagcaacaaacagcatacctgctacataagtgtttggatctcataatatcgttcctaagcctggcctctctcgctgcctggcattgtgtgcctgccacgagaccgggctggctcgtaaaacatctctttatgtactttattacttaaactcttttatttgcctgcaggagccctttaacaaaatcacattgaattgactttctcacaccaaatcaaatctccctggtcccagttcagttgtctttgtcaatatgtattttataaatggagtgaattaacagatgctgttggaacagaagtgctggggtggcgtttatgtttttagtgctctctctgggcagatgcgttgtgtagaagtgttatacaggtatctcgggatgaaagtcatgcgtgtcatttcagtggatatgtattcttagccattttctttgaatagattttaaacctatttattactcatttttttcttagtgtttgcttatatagctttatcatttatgccattaatcttggattggacttgattatatcccttagtatgaaaaggtgaaaaattaaaacctccgtttcattcaaagaggacagatttttctattagccatgggaaactgatcatgagatgactttggaatatattgacttatttatattataaactttgtccatgcggcctttgatgtgaaactctgagttgaaattgtttcagaatacaagactgagttttcatgtcctggactctgacttcagtagaacaaatgactatcgctgtttgtttcataagatgggaatttgggaattttgcagagggaagtataattacagaagtccatggtgtaagggtggcattgaaaaaacatttccctggaagatttccataaaacagaatgattttttttttgaaaagtgtaatatatcagtgctataaaatgtatcacaatgatttggggagcatttttactctaccctctgttttgtggtggtagtcacagagccatctactggtgaagacaagtgtgaatttcttttctttcatgctctgccacaaatgttatacatttgtcctaaggatgactaatcacaaaccttttttttcttctaggcctaaaatatcccttggcttaaaatttggtccccatgaacaatctcagagtttcacaatgatttgtcatattccagactggattttactactatactatttttatctcaaaggcatgatacataattcttggtcttctttaaaaaaaagtggaatcccagttttgcagtcttaactatttagaaattcatccaacagatatgcttataaatgcttttctttttagacatagatatgaaataagcattggtaacatatttgaagtattaataatattgtgagtaaaaattttttcctccactattttctcagttgtgtccaatcaatggaaaccattggatatatatacagtttagaaagacaatatatgctttttcatctgaaaaataaacacctactagtttaatgtgtactgtaccactttactaacatctgcattttgttcaaagacacactccaccttttgtacaaatttaatgaagaggctctggaagaatggaccaatccatcaataatgcatgacctattttgtttttctttgggcatatttaaaatcgtgcattccgtgtgtcaaagttcaaaagtcaagtgctacatgtgataaattaggtaggggtcgaaagttattgcaatgcagtttcggaagattgtctgtctctgaatttgcagctcattcatgctgaagtgatgcactatgggaattactaccaaactctgctccgcaacatctgctctccctaagtgagttagtgcacgtcagacatctttatgtcagaatattgcagtgatggatgcagtcttcagaaaatgctgcataaaaatctggtgtgccgttctggccattaagtgaaattactatttaaattaatggcactgtcacagtttatctgtgcaaagaatgaacgctgattagggtattaagtaattagcaatttatcacactggaacaaggttgataataattaaagaagtaatggtttaccaaagaatctaaaaagggagtcacttcttgttatgtgagtgaaatcttggctgaaaatttcaattcagtaatacaaagatgaagctctttgtgaaagaaggcatcttttttttctagtttaaaaacagttcattatcaaaattttagttgacctgtcagaagtccctcagagtgatcagatgactgattaggagtttcaaattaggtcaatgtctgcatttttattttatacttaaagcatagtgaaaccatgaagtaatttgggaatgagagggggagaatatattccgctccctaaagggccagttttcaaattttgattgctctttaaaagagaaacatgaattgtcttcagaaaactgccagagaaaaaattaacagtaaaaaaatccatggttgtatttaaatgtctaatcagaaggggcagaaaaatgcccgaacaatataaaacttgaagctacggatttttctttttagtttatgtgtgtgtgtacactcatgtatgtatatatttatatgtatttgtgtgtgtatatatacacatacatatgcatacatacatagctacacacacataaatatgtgtatttgggtatgtacttatacatacacacatatatacccaccataatccagactcagactaaaatgagccctgctctttgtattaatttgagataacttttcctagaaatgttaaaaccactaaaattataaatatagcagttaatttgtaaaccaattacttcgaagagttatcacattagataaacatggtatgccaaagctctgttagaatcagtgtatatcattaatcataaataagagtttttaatattagagacttttgtaagtaaaaagatgaatgagagggttctttggagtcatgtgtggataaacatctttcttaaggcatgtgccaaaccaatgtctactttcaatgattttttttaaaagcacttttgatcttttatttgagtgtctttaataatgtagatgtttacacaggaccagattaaacaattcaggaccccagggcactttgaatttgaggttctttatgttatcagtcggaactaataataaacaaacaaaattccaattaaaataaatcattcatcacattgtgctgctatataactggatataaattctaatataaaaacactgtgacatgcagtatagccaccttgatttctagcttgatctgtctctagagtagtgttaatttattcctgctttaatgttaaaatttctgccatttctctttgatggcaatatctaaatgatgcaaatgcaggtaattaaactaaatttggtgggagaaaatgtctatttggtatctcaggtacgtgtgtctttcgtttagatgtggggatcagtgatcctctctacaaggtctttctgcggctgcccccagcctgtcacctgtgtctgtgatgggtctagaacagagtgaggctcaaaaaatagtggctgattagtgcacctgatcagtgaacatgctcagctgattatgaataaataccaaatccatctcatgcagaaaacatggttaccattgcagctaaattcacaagaaacaaatatttgtaccctaaataaagctaagccaaaacttgcactgcttctcccgcagggcttccagttctaggatggtgctacctttccactctgcctgggcttttatcccagagtacttgggtgaccttttctcccttatgaatttctagagctttctcagagtccctatagtttaactaaccttcttctgcaacaagatgttatcatcacaaaatgcgcaggcagttttcatgacagaaatcctatctctttttatggagcatgagagaagtttggcccagctgaatgattttcgaacatttcctcttgtgtgttcttttcctaattagtgtctagtgctcttggtaagaaggaccctcactgcacatttaaatcaccttggtagggaaatgctaccttaggtattgcaccatttcagcaactgcctgagcctgacatttttataccaaactttatagcagcctcagttttcttccctttttctatttcatattcatatataacattttattgttgcaggtatgttctgttgtgggcaggattatgtgaatatgtcagataccatatgctgctcagcttccagtggagagtctaaagcacatattaaaaagaatgacccggtgccagtaaaatgctgtgagactgaacttattccaaagagccagaaatgctgtaatggagttggatataatcctttgaaatatgtttgctctgacaagatttcaactggaatgatgatgaaggtaattgatagaaaagctctcggaggcgctgatttgacaatggaaagagaaatacattgttcataactatttttctaaaataggaatataaaaactcctgtgtgcattattcattttcacattacatccatattaataccgaatgagttcgctatgattgatgttattgcaatgaattctaaaggaattaataatgattagctgttctcagggaagctttacccagcacttcagattagtgcaggactgaaagtctgtgtgccactgaaagagccagcacaggtcgtctggggcctctgcatggtgccatttcatgcctgggagcactgtggatggaggcaggaggaaattcccgcttcttctccctagcccgccagccatcatccaccactttcctttgatagagaccttagatccagcaaattcgcttagttgcatttatatcatattcccttggacaatgcaagatgagcaaatgcctgtgtcaaaagtgaatgaataggcttctgggtgtaatcgcttatgtttttgtatggtgatggtttgtacacagccatgtcatgtatgtgggtattaaacttgacccaggataccagaagcctatcaatttaaggaaaggaccatggacactttaaaaataaacatgctaccgtgttctgtagtaatttgtcattataagaccactaaaaatgggtgtcttggtcacagacaatggaaggacgcttgttcaatgaggcaactacacagtccttgtgtagaccacatacactttgtacactttgggatgtaaaataactcatgagattgttagaagccctgcaagcactttgtatcaatgaatgattaagataacacataaggttggttaaattattctaatgaggacaatatttctccatgctgaatcaagtagtgtgtatacataataatgttcagtctgtaggtttcattttgttttctgaagacctaccacctggagacatttatatcctgttccagtctggaatggatcaccatgggatttttacatagctggcccattcggtcttccctaagctatcaattcaggaattccttttacctctttcctgtgttgattcccctgtttttttgttttgttttgttttgttttgttttgttttggattccaagtttcattccatttggagaattatcttcttgtatatagatgtatggagggtaaattttttaaaagcttaatgtataaaaatactattattttaccctccaacaggattgatagtttggtctgatatacaattccaggttaaaaattatgtctactcagaattttgaggcatttctgcatgttttaagcttccattaatattttgattcctatctctctgttggtaaccatgtttcttttcctatgaaagctcttgaagatgttctctttatcctgctcctctaaaatttcatgacaatgaacctctatgtggaagttaggatggtttctttttgcattttgttttccatttttgtgatgagagcatttaggatctactctcttagcaattttttttttacattacaattcattatgagttaggcagttgtcttccaagtaacatctctagaaccgaagccccttacatcttgtgatgcttcatgcagcccttggatcataatggaaaaggcgcaagaggggacaattgcacacagacagttcctacctggatatagagtacatcctttctatgcactagtcacacagacatatctagtcaggtggcttctcctactgcagccaggtttcaacatcccatgttcccagagagaaaagggaaacatggacatcactgagcacattgcattgtctctgccacattcatctactttccagcttccaaaaaggtatgcactgtcttgtgtgtattatttttctccattttttcttagactttcaacacgtaaaccagtattttactgtcatttagttgggcttttagaggatagatagatagatatagatagatagatacacacacatacacacacacacatatatatatagtgggattctatttatgtagtgtcatcttggctcactgcaacctctacctgctaggttcaagcgattctcctccctcaacctgccaagtagctgggattacaggtgtgcgccaccaagcccagctaatttttgtttttttagtagtgacagggtttcgccatgttgatcggtctggtctcgaaatcctgacctcaagtgatccacccacctccgcctcccaaagtgttgggattatagacatgagccactgcgcccagacccactatatatttttgaatgtactattttgatcaacttggtaagaataattcaacttattttatgtaagagagaggctgaatggagatcaattttaatagcaaaaagtattctaaatacattatgctacttatgtaaaggaaaggcaaagtagatctccacattataaaactattaccttacttatagctcttgtagtgtgggatgattaagtatttaatttccttggattaaaacaaagtggtacttatcaaaaaccataaaaaatctggagatgtgtcagagaaaatgtttataagcgtaaataattataattacaatgacagttcatgaaacatttatatttttaaaaacttggatcagtaatacttctaatgggaccaacttccccaacaacacaggaagtgtaaattctcaaatatcacattctttattttctctaaaattccataggaaagtatcaaatagcaaaaataaaatatttgtagtgtgtatactaagtttaaagacttatcagttttgagtcacacaacaaaccttggtggtaaattatatgatttgagtcacacaacaaaccttggtagtaaattttgtctccatgttccccactgaagaagctgaggttttgaaaacataagtgacttgctcaaggttacagagctgggaagctgcaaaactgaaattttaatcccaatttgtgacatttcaaagtcattgttcttcctagtatacaaactgccttcatttctttttataaattttgaaatattcattcatcaagtaagtggaggaaaaatttcatttgaaagtcacaaaagcctaccctatgtatgtctaaatgaaatttttaaatacccctctctctctcacccctgccacttgactcaggaaaccaaagagtgcaggatcctctgcccagcatctatggaagccacagaacattgtggcaggtgtgacttcaactttaccagccacatttgcactgtgataagagggtctcacaattccacagggaaggcatcaattgaagaaatgtgttcatctgccgaagaaaccattcatacagggagtgtaaacacgtactcttacacaggtaacagaaagcaagctgtctgcccatggcttaatggggttagtgagaagctgctgaaaatgcagatttatttcactctgacatcaactctccttaaactgatatcagtacattccatcatactttgaggccagctagttacaaggtaattaaaggcataatctggatgtattcaaagtcagtactttaaaatgtgttaaagtctatttaaacaaggttgtattccatattaaggtaaatctgtggagatatctgtgacctttactgctatatccagttaatttacaataaatccaatttcctttttcaaaagctgcaatgcagcttccactgaatgcattgaatgaatactgctatactcttaagcagaaagaaggatgaacctgtctgattaataataaaacctaacagtgctactctgaggatgaggtaaacccaagcatgacatttctccaagatggctggtcatctccaaaagaataacctttgcagttattgtaaatattaatttctatgtaccatcttggccctgctgaattagtccaaaatggttatgcttagttttggctgagctgtgtgagaaacactgttaagtttagaattatctctaaaacagttctgccatcaattaaatttgtgttattcatccatttacttaagtccctacaaaatgtgttcttgttttttgaaaaatcaagtttgtgtgtgtgtgtgtgtgtgtgtgtgtgtgtgtgtgtatcatctatcatcttgattcaatagaatccatttaagtgacataatttgagcaagctaaggttaataaacaagcaaaacattgctccattccatcatgaatcatcagtctgctttactcaaccaaggggcaataatggctaacctcaagagtgcagaaagtaaggcaggctactaagataagaggaggaagattaggaagggaagaaaggaacagagataaggttgattgaacattatttagtctcaatgttatactaggtactttaatttttttattatactttaagttctagggtacatgtgcacaacgtgcaggtttgttacatgtatacatgtgccatgttggtgtgctgcacccattaacttgtcatttacattaggtatatctctacactaggtactttaaaaccttatctcagttaccaacaaagcaatcatataaatatggtcatttaacagatgaggaaactgagggtcagatctgtaaaagttactcgccatgagaaagaaacatattcaaataatgccatcatcaaaagggacagactttgaagactccacgtggtgcaggagctcctttcagagtgctccaaatgcacttcaagctgttattccacctgaaatgtcctcctttatcatcctactcaaggcctaggtcaagattcttttcctcaatgcagtccctgtgctgctatggcacattgttcacaaagctcactagctctctcatgtgtcatatggatttggacacttgttccagctcttctattagattgaaacatccttatgaatagggcatttttgtttacctttgcctcgttatttggatttagaacactatacaaacaaaaaatatttcttggaatgaatttaattaggaaaggcctcagatagaggacaatttgtccaaccttctattgtgttcccagtcccagttatagatttaagtcatggactttcatttttaaattattgagtttccatctaagagagttctctacttttatctgccccttgtaatcaagatcaagattttgaagggcttttaataaatacttgtaatagccctctccagaagtgaatagatgtttccacctactgatataatgttatgagggcttttaaaatccatatttcagattgctttgcctgcagaaaatactacaaattgaatatgaaaaataacaaactgttctttttcatgaaagatgttcagcacacaagtggtgctatgataattccattgagaacaatttagattaagtcagactcttttagaaacttacacttgaaagctgacaataccagtgctgacaaaaatttattcatttatgcaatcatttatttatcaaaaattatttattaaatacctactaataactagtcactacattaggactagcagctatgatgacaaacaataatttttcattgagatttcaaccctatatgaagaaagaaggaagcagcaaatgagatttgaaatggtaatgtgggcttgaggatacagaataacagtcattaccaataagtagtttaatttgctgtagcagaaatgtaaaacatattgaccatctgagggtaggtagatggtctaggcaactgaatcgcacaaggtcattcaggtatccagaatccagaatggcaaccgaaggtatgcaattttctctttataaaatgatgtggaagttgtcagtgtctttctatactccttcaagtattgagatctgagtcatgtgaccactagaagctacaaagaaaactggcaaatgtggttttctaagcaggaggcctctgaccaggatggaagggagaactggggactcatggttgccatcacaggcaacaagtggcagatacccccgagcagaaaaaaatggaaaaggaagataatgctttacatttgtagagcaatctgcattttatgaagttctgccccataatttattgcattgtattttcatattagttctatacagtgggcagggaagggtttattgtaaggagatgtatataaggagaatgtctctccattaatctaagcatagagactgagaattaactccacgtccaatggagatgagcaggtggccaggcagccaaggaggaaggcctccttttctgatgctcaatctgagaaagagtcatccagaagctaacacacaaaaatacatacatacttacttaaaattcatcaaattagagacatggaaaataaatttaaataattaaactttcaagtaagtttttcaggggaaatgtgtagcattggtatttccgaagttattaaagcctaaatggaactaagactttggggacacaactgaatcacatgagtgttcatctaatacaatttttgccagtttggaaagctcagcaggcttggttttattgttttaataaagttggttggtttgtattttggttttcagttctggcttttgtggaagagggaaggaactagatagcagagtatgctttcatttttattcactaacatggtaccatgataaactaagtttcaaatcctgtatattgtaacaacattataatccatatgatttaaaattttttaagtaatattaacaaagtaacagaaagcaataatttataagttctatgatactaaaactataaaagaatgttgccaaacctgtctcatgtaggaatcaaaactacatgaatttgtgaagcactaaatcttattatacatgattccagtgcttttatttttcatttatttaatatatccctctttctctgctcagaaacagggaattctattctgtgcaattccgtatccctgcatctaataaatactttaaatgttacttatatttagaaaataaagatattagagttttatttatatacaaagcgtttagagcattaaacatttatttttaaatgtctaaagtttttgatattcacttttaatatgatggttaaaaaatgaaaataagagaaacttccctgtctattttttctctttccagatgtgaacctcaagccctacatgacatatgagtacaggatttctgcctggaacagctatgggcgaggactcagcaaagctgtgagagccagaacaaaagaagatgtgcctcaaggagtgagtccccctacgtggaccaaaatagacaatcttgaagatacaattgtcttaaactggagaaaacctatacaatcaaatggtattgagatacctttaaaatacaaataacaaaatcccataaattcataagaaaattgaaatgagtacaatctacatttaattgccctatgcatctaaccactagaaaagtatgttccgataaagggaactgtaattatgtgacaactaatcactcactttgtggtgtagtcctcgtagatttttagcctaaataagtaaaaaaatagaaatgaaagttccttgaatcccagaatatatctgagctgctttcaaaacaagcaaggcatattcagagaaggggaaagagttttaatattgaaagtaaatttgtttcatagtgaaaggaaataaacataaatgactcttatcatttatgtcaagaatccatctcctccataatagtataattaggaactgcttgagacagcaatataataggaaattaaaattaaataaagctatagtattgcatttcttccgaacactaagatttgtaagttgtttgcaaatagttaaaatgatatcacattcaaatgcagtcatttttctgcttcttttaggtcctattatttactacatccttcttcgaaatggaattgaacgttttcggggaacatcactgagcttctctgataaagagggaattcaaccatttcaggaatattcatatcagctgaaagcttgcacggttgctggctgtgccaccagtagcaaggtaagaggagtttgcctaaactctgggaaaaggggttcagtgtgaagattatctgaacatccaggttgtgactgcttttttcattgaagaaaacaatgtccctcctcaaagtggtgttaagtagcgtgttcatgtgtcacgttaactgagtgctaatacctatggctggaaggagagatcatttcaagggagatttatccaaatatcaatcttgtgttaatgaaaaacaagtgaaatcttgaagcagtaccatcttttcttccacattctttcctcaccaaccaattttaggtaatctataaatctataaaaatgtccaaatcattattcagttaaagaaagtttctatttaaatatgatatgaacaaaaattgtctgattttaaaaaatgaagagaagggcaaaaaagcctggcacggaaaacaaaattgttccaagccttctgctatagccttgtcaagaaataatgaagacctgaatttaggcagcagaggtcagaaccgagaatacagaatgatacaacagacatgggggataaaatctacaaaacttggtactcaattatatttacagaaataaaaggaaagagtcacggatattgtcaaatatctgcttgagtaatttgtggatcatggtgctattctgcaagcaaatttttaaaaaagagaaaaatgttgaaggtaaaagaataggattctgttttgttaagttttgtaaaaaatatatttaaagagaaggatcagatagcagggtggcggaagcagatagtacttggcactttatgtgaaaatatctggtcagaaaccagattgagaggtgactgaagtttctagaaagatctgtatgggaagttgaagtaatgagtataaatatggacatggaaggagaatagagagaaacaaatatggaatattgtggatgatgagcactggggaatgctaccaaatgaaaaagaaagaaaagcccacaaagaagactggaaataaacaatcaaacaatgtgggagtaaaataaagaaagggacatttcatagaagccagccttgacagaggaagcccaggaggaaacaaacttacacagagtagctctgattcttttcatatgcttaaaactttagaagagcaacatctttgcacactgtgcaagagccatccaaatgaaacattcagccacactgctcagccacagtgcaagaatgcaacattttgttcaacagacttctggaaacctttctgagtgagccaccatttagatagatagatggcagctgattggcccagtcaaaagttattagtcctagaacaattccatgctttttgcataggcacacttcatgcctgctacatgcaaagcaattgtttacaaagtgaaaaaagttaattctatgaaagaagccaatttttgtccaaaactatgttttgacaatattgactaagtaattgatttatttttttcttctgacttgtttctttctttagaaagttggtgcagacactataaagtcatcctaggtatcatgggaagagtaccgaaatgtctgcccatttattctgttcaaagcatattgtatgcaagcaagttcagatgtggcttttgctccatatttactggtgcttaaaatgtatgaaatcaggctgttaaaatgcaaagacactgatgggccatatggaagagagttatcaagagttctctagtaagacagtctgccagccagattttacttgtttaaacactgagggctgcactctgccgtcaaaattgttgttgaacctgttgtgataaatggtagtgtgagacttatgtaatatattcaaggtcagatttcattgtttaaataggttgggagggaaaaaaatgaaaaaaaagggaaatgcttctccaagcccctgctaatgatatgccaggccagacaacattttaaaacaaaagtgacattctcattgatcaggatagctagtgcactattacaataaattgctgcttaattcctacgtcttcaggtagttgcagctactacccaaggagttccggagagcatcctgccaccaagcatcacagccctaagtgcagtggctctgcatctgagctggagtgtccctgagaaatcaaacggcgtcattaaagagtaccagatcaggcaggttgggaaaggtctcatccacactgacaccactgacaggagacagcatacggtcacaggtgagaaaacaaaaaaaaaggaaatcctactggaggagtctgtcattgtggttaggggggcaaagcatcccaggggtgtgtgtttgatatatgaggtcacttcgaaaggacgtgttctcttgacatatggtcaggtcccacttatccatgctaatagaagagcccacactggcagcaatacgccacaacagcagataacttcagaaataatttatatttggccttgatatgcattatgtgaagggtttttgcatcagtattaactttttttttcaaacaaacagtaagatgcattttcattccccaaggatatactcatagttaatgggactaagatagccaagaatatactggaaggcaggggaaaatcagccagaggttaacatttgtctatcaagtggataattaatacacaggactagttgacagtggagtcattgtgactgtttgttactattaggaatgttaattaatagcaattgtgtttttttaatttattataatgtttattatcattagccttaataatatactattagtacagtacaatgatatgttagataattgctagtagtgattatgataataattaacaggttttagcttaaatgccacttctgaagggaggagaagcattttctgacttacttgctcgaataggttctctaacacaccaccacatcactttgttttatttccatcatagacctctcactgcctgatattttagtgtttgttttttgtctttttatgtctctccacacttgaatgtaggctccaagagagcaggaaccttatctacttgttcagtgttgtacctctagcacttatagtcctgaacacattaataggagctaaataaacgtttggggaagaagggaacttaatatgtgccagacgctgtcctaagcactttgagtgcactatgcaatttgattctccatcaccaacctaagatgtacagtgaattactaccttcattttacagaaaagaatactttgagaagttaagtaatttagttcattattcgagtctactgaatcatcccaaacaaccctgttaagtttaaattctaagaccatgggcaagattgtataaactttcccttttttcccattgtcagccacctccttccaagacttcctgagtggatgacctccttccattggactgcactttttgcagggggtgttgatagcacagataatgaaactcacagaaaagtgcagaaaggccttggaaaaatgtgactgatttttcctaagaagggacacaggttacacttacacagggtggcaaaataaattcatcacttttcactcttaaatgccacaattccctaacacataagcaagcattcattgacaaaatctccagtatttttccaaaagggccgtaaacctgcagaaggtgcttaatacaactcttggcctggcacattgtattccttacctcaagatcctgggctaaatcaatgatgatagtgttgaggctgggtgcggtggctcatgcctgtaatctcagcactttgggacgccgaggcagccggatcacctgaggtcaggagttcgagaccagcctggccaacatggcaaaacctcgtctctactaaaaatacaaaaatcagttgggcatggtggtgtgcatctgtaatcccagctactctggaggctgaggtaggggaatcactccaacctgggcggcagaggttgcagtgagctgagattacaccagtgcactccagcctgggcaacagaacgagactctgtctcaaaaaaaaaaaaaagataatggggttgggagaagccctcatatttgaatgatcaaaattatttcttttatcttattttacttgaagtggaaatcatcacaagtgattgaaataatggtgttttacataataaaaccttacttctatgtggtgctttatcatttaaagaaacgtttgcattttgacttctctgactctcatcacatccttgtaagagatgtttttaataatcatatctgaaagatgaagaagaaagccaacctactcagcgtatccaaggcattcactgcctgtatctgaaaggaaatcagaatatcatttcgttctcccaaaaatgaattgccagcttgcagttttccagatagtacactaagtggtctaaaataagactgctgctcttaagatcctctcacgtacagggaagactgacaagaaaagaaataactgaaaacagagctctatacaggatgcagtggtgaaaaatcaaatgagtcacttggagtaagcaatgggatgttaattacagggttttgaaaagcaagtttaggcacattaagactgtaccagcaaaggtttcacaataattgtgatataaggctaaagaaatttcttcttgtagtatctatcaacttaaccagcatcagcttcgaattgttgctactttattggtttgcattttttagaaatcagcatttatacaccaacagaccaaattcaattgtaatgttcaaaccaacaggattgatagcctcattaattataaaataattgcaaagatttttctctaaataacttcaccctaccagttcttcctttcattgacatttttaatggctatttttatgtcagagtagatttcatacatgtatcttggtgccagaaatcctattattagcataaatattttaaggttttttaatataattttaatttttacttaacagtaaaaaatcataatctggtaaaagcctttaggagtcctttgaccaatctccctgttctacttttgatttgttttaatttctatggatattgttttaaatagatttagagagtatttcacttgcccaatacagccctaaagaggggtttctttgtagaataaagaaataagtcctcattcagcaaaaccttaccaagtacagagcctcctatatgtagttctttggggacaggaatggtgctaggcattagataatcggaaacttgagatctatataatgttactcatttgcccaggaaaattcagttccacggttagctgactgaccaaatgtagtactgaagtattttatggtgtgaatgactgttttattgagttcatggaatgaactaaaataatcaaatttattttctgttccatcttaaatgtttgatggaaatgctgcctgaaccccctaggataaatgttttgattttctcatcatttccaaaagcttggcattccctaagcaacacagcactaataaagctgtagcactagtcgtcctggagcctgaaaatctaggtccttaggaatgacaggagggaaagggagcaccttgcctcggccccattgtctccatgcttatttttaattacctcaaagctttagaaacatgatcccgtaaatgctttgtgggaatagtggcgaatgcactcatcatgtgaaatccataaattgcttataatcctctcaagatgttaaaaaaagcattaagtaattgaagacaggaagtcctcggttaattatttagaggtgttatcaatgctttaagtaaactgaagcgttttctgctatctcactgagctgaataccatggggacgaaggagtagcagccatcatcttctcatattcgctaatgcaaacagcgcatggcagcttgtcaataaaagaccttttcatatcatttattactaaacacatccaccatcctgtacagaacaatttggacatcagttatggcattgtttcactttgggctacctctacattatacgtaggcctcctaatgtgagtttaggaatagaagaaaggattaactaaataattaaggccactgagaaaaaaatgaattagtcatgtcctgtttagcataacgtataataagggcctatgtgtctcttactctggaaaactattttcaaaataattaattagaaattactcatcattgcatttcatttaaaaggaaaaactcaccagcattaaattagcaaggaaagaataatttactttcgtttctcatcttcctagaagttaatgaaaactttgtgtgctaaatagaacaaaccctaacaatgctggttgtagcagaaaatgtaatactaatgttatactgaaacagataccttacacttcaccttggaaaaagagaaaacatactttaaccaccaatacaacaaaatgtagaaattctttgtaagggattttatttttagataactctgctatgtgttcccatattatctttgctctcgtagtaattatcacattttattctaatagcctttcctcttgtctctgttccacacttagtaataggtaatgctttttaagtacagagacagtagcttcctgtttgccattgtgttcctggtacctatcacagtacttaatatattcaaaaaatgtttgtcgaatgaataaatactgaatagtaaactagtatttgactacattctgttttgaatggagataaaaatgccactgtcaaacgtatctaaatcgcagacagatctggcaacaaaattgtggggtccagtgcgaaatgaaaattcaggccccttgttcagaaatcattaaaatttcaagacaatggaagcagagcatagaagtaagctcatgtgcttccaagcatggtaccgtgtttgattgcacagtcgaagcccacaaagccaaccctgatctccagcagtctggaattagctgcagtatatttctttaattaaaacagatagcaagaaaactaggatggtgataatgtcctcaaaaagctttgggagtttcttctatggttgtttgcaatgctccaggctgcattccccccagttactatgtaattactgaccaccaagcactggggacctgtgaaaatagagataagaatttgttttcttttcattttttcaactctgagaacaactaaatttgtgcctgaccaaaaaagtaaaaaaaaaaaagaaaaaaaaaagtgtggcatcaaccacttttttgtgttttaaaacctgcctattgataaaatattaaggccaaagaactataattgatagctgcctagacaatgatattttttaaaattccccttaaatcccagatattccaatgtactttgccagatactagttctgttttgtcactccagttctggccacccccttccctctgcaatgtcctcattgtctcacgtttgagcaacatcagattttgctgccacctgacatcacattttgtttttagagaagaaaagtctgcctggaaatgcagagaagaatcctcagtctagcataacactgaacttgaaagaggaaaagtatttattaaaatatttattaaaatactgtcactaaaatcaaaatatatatatcacagatataattcatattatatttttgttgttatatttattccagatatacatcaacattaagactattatttagacaccaccaaagaaaaagggtctttccttggtggtgtctaaataatagtcttaatgctgatgtatatctaaagagagtctgccaaagaagtaacttgtttaggaaaggcgtcttgggatcaggaagatattggagagaggggcctaagctatggcccagaatttcaaatgaaatatagaattaataacgcaagttagcttatagcaagtagtcagaactaaaagtcatgaagtgatcttactggcatgtgcaatgcaagagtccctttgttttgatgttttgatgttcagttcatatgaggtagcaactgaattcataaagcatgaatacagaaaatggacagtacaaatgctgctcaatgggggggaggaaattggcttgggtaagtggaatgggcagctgttgagattgtgaagaatgataccatccagaaaagatggctttagcatgtgaactcccgaaataatccttaatcaaatcctgtaaaacaaattctaatttaaaggtaccttagatgtctgtaaagtaattccatgatgcctttgtataccagttttgaacatctggattttcacagattgtcagattgatctaagtagaatgctgatatggctctatccatcacagtcaagatcaccaggggatgctggaagttcctgggaatctcagtaggcagagatgctccgaaagggatcacttagtgagatcccaggcaagtgagggcaaaaggaagcaacatcattatagttgtctgggtatatactctggggctcgttgtcttgcgccaagaaagaattcaggacacagacacatgtgggtgtgttaaggagtggaaagtttaatagaagaaaggagagaggagagcagctccttgtgagagagagagagaaagacagagagagagagagagagagacagagagagagagagagagacagagagacagagagacatccgtaaagtggggaggcagcggaccaaagcagattttacaggcaggctggagaaggcagtgtctgatttatatagggctcacagattggttcgatcaagtatgacatttacatagtgggaggggaaggctggtcaccccaccctaatcttattatgcaaatgggccttccagttgattggttccatcttgtctgagccttacagtacaagtggctgacaaggagaagggaagatggagcctccatcttgaacatgtacagtccttagttcctgcccacattcacccatgcaagcacccagcttgtttacctatgtctgcagctcgattttacatgcttgccctttgttagaaaattatttggggctttttactaaaaagaaaaggcttaccgaggactcccatacctttactatctgcctaagtgatttcttcttaactcctgtatcattagcaaggactgaatgtgagcagccgaggggccagaccacacatccagtttgggtgaactggtgccaggacagatgacttacccgcaggatggttattcacaatactttataagcaccaaacaaaaactttttaacgtaactcaggcctctcagtgcttgagctaatcactaaacatgctgatggaggaactcactgaattacacatcctttaggactatttggtaattctttagaacatagcagatgacactatagaataattggctgaatgttttgaagtagcacttgctatgtgaaattataatggctaaagtgcctttttttgactatttatcaagagattaaaaattggaagcaagctgttctttatagagtacatcaaatgttaactttcatagacatgggttttgttttccaaatcatatttttatgaactaaaggcagactttttgcagtcccttttagcacacatttactcttcaaagtaatgttacttggaagtgtaattgtaatgagtttggttatattatgcttctttcctttaaaaaagaacatgattccctgtagggaaattcaggtaatttgcagccacagtaatcttcactatactgaaatgttaaatacttggcttttctccatgtgtttgcctttctgtactctacaagtgctatttcctactcttctaattcaatgctgagcacttgaatgatgttttcttttctccttctactcttcgacttcaggattaagttacagttggaatggttcctttgagacatctctttatttccctcttctcatcctgatcaattcatgagtagttttcaattggtgtgccctttttattgcctgttgctagtatgtcatatatatctcattttaaggactaccgatagaggcttacttaaaatgacagcaaattccagttgaaatgtgttcattttattgagttttacagagtcgtatatatgaaaggtcatcaggttcatgtaaatcatctatgcctgatggtagttgatgctttcttacagattatctgaaccaagcctattagtaatccagtcctctaacaatatgaaaaatataaaaactaaaagatagaatatggttttaaattttctaaattatggatttagatattgccttcccttaaattaatctgtaggcctattaagcagtctctactatcatgcctacagtttatagatatagaaactgaggaacctagaagccagaaaacttccttgtagtctagtacttggtaagtagataagtattagaacccaaatagtctaatttcagactgctctcttagcacagaacatgactcagtatctcactacatgactcataataatattcaaaatgaaaatatttaaatatatagtcccacttgaatttttttttttttttttttttttttttttttttttttttttttttgagacggagtctcgctctgtcgcccaggctggagtgcagtggcgggatctcggctcactgcaagctccgcctcctgggttcacgccattctcctgcctcagcctcccaagtagctgggactgcaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcccggccgaattttttatattactggaaatttgactgggctttgagctatttatgtcatcgtttttgttataaggctgggaagcctaacccagttgctctgggccacatttctcagtgtaattgcccaagttccaaccttggcctcaccctttccttttctttctttctttttttttttaggcagtctagctactatgtcacccaggctggagcatagtggcaggatctcagctcactgcaacctctgcctcccaggttcaagcaattctccagcatcagcctcccaaacagctgggactacaggcatgcaccaccacgcctggctaatttttgtaggtttttttttttttttttttttttttagtagagacggggtttcactatgttggccaggttggtctcaaactcctgacctcaagtgatccacccgcctcgtcctcccaaagtgctgggactagaggcatgagccaccgtaccaccggtcccggccctttcttatgtctgtgatcataggtactttcctccaactttctgtgccttagcttccttatctgtataatgaacaaataatagcgtgcacagcagaaagttagtgtgggcgttaattatattaacacccatgaagtgcacagaagagggccaactagtagtacatgctcaataaacttttgctagtatgtcatttacataatcttataactaacttccttgaaaataactgcaattctcataaaatatatttagataatgtatagagtccaatgaaaagagaattaaaaacagaccaacaaaaacaaaaacaccctgagttttgtctgttgggtattttttttcttaatttatagtttttgtgctggtgtttgaactacattcttttaacttttttttttcgttttgagcaactacagtgtatacaattatgacttgccaattaaaataatattaattttaataaagagcagctgcaatggtttctaccatttttatgtcttctaaatgctgcttaatcttcagagggaaggcagccattgagtaacttaaatactgttagctctagctcttatgtgatggagaacatagagcttggtattcaggcttgggtcatctatgcactcctcagtccaggtgaagtcaacgctaaataaagtacaaagcctgatagtggacaaatgactggcttatccaaggaaaatgtgagttttgttataaaaagcaggaacagaccctggaaggtaaatatggcagatgtgaagttgcttgacacacattagcaaacatcatttgaaatgagcctaagtattactaccctttgcccacatggtccattaaactggtcagcatggctacatttcagggacagacacagctcttgaggataaagtgccaatgaattagagtaaaactgtcattctccccatattcacttgcagacatgtctcccactctcatcctcctggttcttcaatctttgtctcctttcctcagtgcaccatgttgactcctcttgatttgataatatgtttgaactcctctgacttcttgacgaaggttttctgctcagtgctgagtctgccattcctccttgattctagtaccccagtagcttcaagagaagcaaattccttccaccagccctacccccatatcctgctaggtgaacctatcccatctaatgtaaacacctgtagcaaactcctttgatgcactttcctccctctatcaaaaatccttaaggtgctggatgctctactgctgtaccatgcctaaacacctgccttctcaaattctaggctgtaagtaaaatggagaccactcaacttgcagcagaaaggctttgtcaagaaatgacaatttatatttttatatacattaattttcctttcagctacgattctcattacaaatacgcttaatcctctaatcaaccttagcaaacctctgtgattatgaattttcttttttccctaatgcccatcctaaaattttatttaacagtcactgcatgtctgaaatcagaccagccacgaccacaatgaggaagataactgaggccattgttttgctcagaatattcgagaaaaaaatttaaatatctgtttacttttagctaccatatttacatctggcattcaggaaaaaatctagaatatgtgtattgcccacaaattatattagtttctgttattttattaatattctgcaactaaaaaatatctccaactcaatgaaatcattgctgtggacagggataccgatggaattatgaggaaggacctttttggtcaggtcacatggtgataaacatcgtagcctcatatccctgcaatccttatgggacactatgatgggcatgctcttctttaagcaatatttgttcaacattgaatgcctaaaaatgggcactataggggaaagtgacctcccaaaaagactcgctcagtgatgccatttctactctcaaagggcttatattctaaatggggaaaataagatattcaggtaaaatggtatcacactggtcaagacccctttttgtcggtaaagagaatgaaggggagacattgtcgagctaaacgagtttgccactgcaacctctgagtttcattcttgaatgttcccttccattattttgagctttacattttgtaatcatagcattttccgatgagcttttatcaaacatatgtggcttgggtacggcttagatctttagtcatattcttcatctgtaaatcaggtaaatatcaaaattatgtaaatcctccaaagcaaccaaatggaagattgtaatcaaataagtgcctgcatcttatcactaagttgataaaaaaaatacaaagggctctgaagctaaaccttggagcagctccagctgcagaacattattgctttagcagagaacccagactactgctctcattctaaatggatgagatgggtaattttttcattcgtttaacgaacacacactttgtgcctgtcacaatcctaaggatacagataggcaaaacaaagttgttgttctttcagagcatacatctaaagcaggagacaaatatcaaataagcaagagacacagcaaacatcagagacggttgaaggctctgaaataagaaaattatgtgaggggataaaaagggatgggtggattgtttagataaagtggtcaaaattttttaaaatgtagtatttgaggagaaatctgcataaatagacaaagtgacacattaacatctctgaaggaacagtcattccaccaaaagaacaaaatatgcgaaaatgtagctcaaaatacgtgaaaaaataagcataacaatcattggattcatctgtaacttagttcaattatttaacaaataggctcagtcctgttgttttaaaatactatttttttctcaaagagagctttggcattgtttgaactttcccaagagtcaagagagagatgtcttgtaagcctcaatatcctccttgttgaatgctgctgagctttaaagttgcttctgctagaatgaaatactactttgagtatcctatttcatcttctcttgtctgctagatgctataatgattccccattttacagatcagtagaccaaggcaaagagaagctaagtaactctaacaaggtcaccagccacgcacagagcagcgaaatctaacaatatacaacttctattttagatggattgtcattcttttctccctgaaaacttactgaacaattaccatactgcatcatattctgaatacgaaagaagtaataagcaccatctcttctccaaattagctttaatctatgtgtaaagacaaaatcaacacacctcaaaaaagggcgcattagatacagtgcaaggtttaaaaacaaaagtgttggttagcgttaatatgagttgaatatggcttggggcaagaaaatgttggatctaaccttctttttattttcctgcccgtatttatataagaagcaattgcagagactgggatggttagcctggagaagagaagactcaggggggatttgataactgtctacaaacatttgaagagctgtcatgtggaaaagaaattagatttgttctatatgtccccaggggtgaaagtgatagaaagatttcatcacaatataaggaaggactttcaaacaaaataaggataactctaaggctctctaaagatgtaatgggctctttgagagacggagtgctctgatccgataggcaggacagccttttcaatgacatcttgtatagggaatcaagagaagggtggatggttcacatgaattttaaggtcttttctatggctgagaatttattagtttatcagtgataaatgaaattttgcccaatacttagcctcttatgaggttcagaccttctttaaagagtgttttagagagtactcttaaatgttttggctatcatatctacaactctgcatgttacttctggtacttaattgataataaataatcctcttaaggtgcactttatttcttgcttgctttttctaggtctccagccatacaccaactacagcttcactcttacagcttgtacatctgctgggtgcacttcaagcgagccttttctaggtcagacactgcaggcagctcctgaaggtaatgaaacaatatccatggtttgagggaagaaattttcacatagcattttgaggtggaatctgtaaactccttcataacaaataaggaagaggcaataaagttgataggtacaaaataaaatagcattctaggttcccattcttcaggcttgattcatgtaggtgtagcttcccaaggtcagttcgctttcaattctttaacctttatagagttgattttctgtggaaagaagaattattgaaatttttcaaaaactcagatgttaaatattttgggagcatctaatatataataagcaccatgctcactgctgaagttgtttaaaatgttctctgccctcaagactgacaatcaagtagaagtgataggagaaagatctgtatgaagagagaaaatctgaaagttgatgttaagaaagaacaaatgaatagagtgctaaggttggcctgaagaggaagagatagaaacccatcgatgacatcaaaaaaggctttatggagcagatgacttctgagatggaccacaacaaacaaggattttgacaaatgaacagtgatgtacagagatgtacaaccagacacagttggaaggaatgtaagatggaatcatcaccttagaaggcaaattgcaaatgtctatcacatttaaattgttaatttcccatgatacagctgttctattttcatcatttatgccagaaactgtgccacactgctcaaggaggcatgcaccaggatgtttattgaagcatttattttgtttaatagcaaaatgttgggagcaattttaatgtttgtgagtagaattgctaaataaattcagctattctcatattgtggaattccatgcaccagtataaaagaatgagatgatcagttcatacaaagaggaagttatgacattatattaatttataagaacaaactgagaaaatggcatttattgttaatggttaataaataaatgcatttaaaaatccaggaagtatacacaccaactgatagcaatggttacccatgtgttcagaggtgggatggctggtgtcatttactttcaaaagaaaaatatactcagtggcatgtgttagtgatcaactaattattttgttaatcttcattatctgcctatttttcatatggggaaaccaaggcataaataagtttctaaacagaaatgcaatgttaattaccaccatagactcctgaactacttgtccattactcttctaatgaaatggattgttgtacctcggaatattagacctgaacttcctaccagtaaatggggaataaaatggaaaattccacatatggggcatatggctcctcaccaggaattcactaatgatgttttctatataaagaatgtttcatgtcaaaaagcttagtgttcctttgaaaggaagaaaccagcagtggattttttggaaaggtaaactatcaaatggatactttgatgataatggataatttctaaaggatctatcaaccagatttggctgaaactcaacctgataaaataacagaatctcttgttccatttctctctaccaaattcatatatttaaattcattggaaatatgaaattttcccaacaaaatttcttgaaatgacttacattttatgacttaaaaattgtagctttcaacagtgcagggtaatgtgatatgagaaatgcccttgatttcttttttttttttaactttatgtatctttcctctaacacaaataatcatgcaaagaaataatagatgaaatggactttcctctgcagaagaaacatggatttagggccattttctggctgaataagtgccatttatatataacccatatatgaaataaatatagtgtgaatgcttaacttgggaacaccttagcaatcacattaagttctgttgttttactgtaaagtgaaaacaagtataccactttagattatccacccagacataactaattataaaatgccattttcgaagtacatcagatataatttgaagatctcatatttgagtattttaagtggacatggaaagaattaaaagaagtgtttatgcatagccaacgcaagctgagctcttttcacttgcctctcattttcaatctaagaaaaagtcaatgtacattacaacctcattgacaagttggacacagttctctacagttttatcctcatagaaaactgtgtacctgtacctttagtcaaataacaggaagattttgaattgaattattactctttttttctacaattactgccatccatgtgagttctaattcattttagagataaatcatgcaaaattgcagacatactttcctctagcattgataatgtggaaacagaaaggaaaagaagacccagtctttttcagttcattccagattcctcttcctctgcccttcttttaacgtttacacacccttggttttttcctctactctttacactatagcacccaggctcttctggaattttcgagtactggctttatctcctaatgaaggctgagagctaccaaatactaaagctctcaccaaagctacacttatggatttaaatcctatgtatttactggtctactacatgtttatatttaggtgtttttcaaaaactttaacctcagtacttcgccacttaattcttccactccactctactcctcaacttgcttttcttctctcaaatactaccacctacctatcacctaagcccaaagcttgacactcttgatggctcccttttccatatgtaatacataattttttataaaatctaattagttttaaatcttaagaattttttttaaaaaaattgttcttctttcccgtcccttttaacactgccttagttcagatcctcatagctataagaagagaagttctctggatcctcctaactaggatcccttcctctagtcatttttcctctttctcacatcccacatcctgattctttttcctcttttgacaaaataagaatatgtcatattattcacctccataaagtcccatttccttccaggaagacatacatccatatctccttagcaaagcaacatggacccctcaagttttaacttccatcaatttttcaaggctttccatcttccccacatgccatgcagtgcaccagccatgccaaggtatgtgcagtcctgccatccttgcccacatttctacgactttatgtgggttcccctcagcctgaactccctttccctacatcctcactcagttaacgctcaccttttcaaaacttggttcacgcatctccccttctggaaatcttccactacaaccacctacttcctacccatctccacttctccccacagtctgtgtcaggttaccctttctaagtgttctaacagctactgtgcctccttctcttaaagcatgtatcatactggagtacaactttttatcgactcatctttattcaccatgatacatgaactccatgaaggataagaaaaagtctttatcttcccatccacagtgcccaacacagaaaatgacacaaagtcgggtagaatgttgagtgaataaattaacaaatactaaattgtccagaattcagtgcatccctgacatcagctaatacaaaatttgttcctatcaccagatttcaggagaaaaacaatccacaataaatgctgggaattttgaattggaatgaagatttgtagggacatgagaagtgggtaatatggcatgcaactcaagataaatttaaaacaaatacagtagacatgttctacttgttgtcactgtgtaaaaaggcccaccaaggtttaattctacctttccccttttaaccttgcagctagtttaccccaccccatcctcctaggttacttccctccctactattcatttctttcacttgaactgcctcagtttgctcccttattatatagaataggtttttctggtttcacctgagacttaggccagagttacatggtgaaggggacaaattccccacctcggactcattaatatatctcaccaaagattgtcttactctagcaaagatttcttgcagctgccaagataacgatgtccccatatcaccatccaagtaaaaatgcagcactttctagttatatatacatttgaactccatattatcaatcaaaccaatgggcatggagttattaccaacttgaaaagagcttttgccagccggtataaataataaactcaacttttacctaaaggttgaaacaaacccaaaattatgtttcattttattttattagctcctccacatccacaggctttattgactggttcaaatcagaaaccaagcaatagccattctagtaccttggtgatttttaatacatcgttcaaggtgaaaaagatataactgcaggaagcagattatgaattaagattttatactttatcttttgaatcaacaaattaatatcacatttaaatcaaaactctgattggttgaatcatctagcagctgttggcagagaaacccacatacaaatgtgtactatgatttgtgaattttaccaaatatctagaacagagcagactctcagaacaaaatgaactactttcttctcaggaatatattgctccttagaaagttgggatgtttgagacatttttgaaatctatcttgtttctttcaggatgctgctaaataaattgcattttgttcttctgaaaatttttcttctaaaagtgtcaaaatcttaacctgtacggagtaacttacacaggagatacaatcaagcaaaagctattgattacagggaacctaatattgaaatgagttttttttaatctccagaagagatttacagtgtctaatcagagtataactagatgacaacataaagtggtaggactgaactttctcactgctggcttctccatcgatggatttgtacatctataagagtacttgaatgtttgacattgaattacagttgtttgtgtgtatattttattttttagacagaagtataaactccttgaaagtgagccacatcttagtcatctttgcattccctagaactgcctgcagtgcttagcataacattttgcaggagatatatttacaataaatctactcattaaacatgtattaggcattgtgttatccatagagatacattgacgaataagacagagaagatccctgctaccatggaactaactttgcatcaaagtaagagaaaggagaggactgcaccatcatataatgtaaaaataatagtatgtcaaagaaagaatttgattatgatgtcttgagtgttaagaaggaaatagaaaaggccatgcgatacagagaaactaggttgggactccattagatggggttcaagttagagttaagagagtgctaaaatgaggccttatcaataaggtgatagttacacaagtaactgaactatgagaacatatgagaacattctacatataagaacaattctacatatgagaacaaaatgcaaaaatgtcatgctgtaagggaacaaaggtgttccaggccaaaggaaccgaagttcaaaagcccaggtgtaggaaataactagaagcattctagggatagaaaggaatctggtatggccacagctctgtgaatggtgcaaagaatgctgccacttaggccagagccaataaaatgtgggaccatatgggtcacaaaaagaaattgggattatattatatgaataaattcaaaagggttatatggttcataaagatgacactggcttacatattcactttatacacttttacaaagattccaatggaatatggaaggccaagatttcgacatggaggcaagtttagaagctatgacaggagtttatgagagagagaaacgtggcttggaccaggagaagtgaaagtaaagatacaggaaagtatacattatagaatcttctgggctttatgttagattacatttgggcgtatgaaaggtgaaagtctcagggatcattatttttgtgtgttttgtccaagaaaatggatagatggacaagattgggaggtacatagattgtagacaggaaaaacaagagttctgttttgcatgtttttagtttttgatatatcatcagtcatccaaatggaggtgtcaagcaaacagttggattcttgagtctcacactcagagtttcaatctagagatatgcctttgggggtcttcagcatatgcatatttaaaacccatactgaatgaagatcacctgggaagccggtgttggaagagaagagaagagagaaaaagaagaagagaaaggaagagagaaaagcagaggggagagagagaacagagcatactgctctgaggcattacatcctttcaaggtccaggaggggaagagatcccagtaaatgaggccagaggcatagccagagaggaaaagagaagcatcacactgatgtgcaagaagaagggaaagtgcactcatttgttgaattgtataattcaggtacatactcgattatgcttactttcacatattccaggtaaattgtattaaaaagtttgaaatccccagatgatctctcaggccttgatttaaaatactctcagagtgacaaccaaggcagagaaattatccactgctagttgtctgacattcactttccaaaggcaattcaaaaataaaataatcaaagtaataaaaatatatttacaccaattatgtatttttgttccatacagttagatattttttaaaatcaacagaaaaaatatcacagttcatgggggggatggtgtgacttttgatacactgtttattttctcctaacaataaaacctcattgcgttattcttgccaggagtttgggtgacacctcgacacattatcatcaattctacaacagtggaattatattggagtctgccagaaaagcccaatggcctcgtttctcaatatcaattgagtcgtaatggaaacttgcttttcctgggtggcagtgaggagcagaatttcactgataaaaacctggagcccaatagcaggtaaactaaaagaaaactttaccaatcatacagcaggatttgtacatttctctgggttgataagaaatgcatgtcccactgaaagttgttaaattgtttaattaacttcctcattcattggccattcaataactgatgaaagtgctaaatcattcagtctttagacttcacgaaatttcttaaaaatataaataattcgtcttctgtttgacataaaagcatgagaatttttaaatatacaaaatacatgaagtattaaactttaaaaattaccaaattatcttcaaaaacacgcatccttgaactagcaataaaagagatgtaaagagttttgttttccgtcaactctcttttcttcttgtacagtgtttctctacttgctacaccacatatagttgtgaatagttttagaggaaaaagttccacatatttgcatttcattcccattcatttctcagcagagacaaaaacatatcttaaatcaacagatgttttactgtagaaagtagagatcaatttcattttattgtaaggaatagcagatcaatttaaaaacatctttctctaaacatatttccctgaactccaacctatttaaaaatggggaagattaatttgaatcctccacaatccaccagcacactccaagactttcctgaaatcttcaagaaaagctatgaattactagcaggttaaaaataaatttaagagcagctgaaattacaatggcttggagacaatgttgcctgtgcaagaaaaactaccaagtcaagtttctggaaagggggcaaagagtttgcaatttgtcacaaatttaggactaagcaattgatacaaaaactagtaatcattgttcaagtctcttgtgcatggccttaccacaattcttctttctttttaaatatagatacacttacaagttagaagtcaaaactggaggtggcagcagtgctagtgatgattacattgttcaaacacctatgtcaacaccagaagaaatctatcctccatataatatcacagtaattgggccttattctatatttgtagcttggataccaccaggtaaaaaaaaaaaagaagtatgtgtgtgtgtgtgtaaacattttaaaggaattaattagagataagaatagaactgttaatttagtaaatcagaaagacatagtcggtctcctggataaatatgaacagaaaaatctaaaccacacttctaagtgtatagacgcatgagtacatacatacatacgtagagatataggtatctagatgtcgatgtagatatgtaagtatatacagctttctatgaaagcaacactttcaagtacaagagactaaaaatctttttactcatctattttttttttttttttgagacggagtttcactcttgttgcccaggctggggtgcaatggcgcaatctcagctcaccacaacctccgactcctgggttcaaacaaatctcctgcctcaggctcctgagtagctgggattacaagcatatgccaccatgcccggctaattttgtattgtttttagtagagacagtgtttctccatgttggtcaggctggtctcgaactccagacctcaggtaattcacccgcctcagcctcccaaagtgctgggattacaggcatgagccaccacgcccggcttactcttctatatatccaatgcaagtcatataggtcagaattaccttgaacattcatttccatgggactccttagattggatcattgacattataccattccttttatattaaatcagtgaatggggagtttggaaagacagttgttcacttcacccatgtaccttgggttgtgaccacttatggtagctgcatttttcctctgtaagctgaatagccttcattgagccatttagtcattattgggttgccttgtgacttagtgcaacattatattttgaggtaagcaccatcctcaggtaaaatcctgactgcattaatactgtggagtaaagagtagagtgagaaaggacatatggaggacttttctttccaagtaaaatttaaaaatggttaagatgttaaaaacacttcaaaattatgtgactttatttttaatatctagtcttaagatgaaattgtgacacgccctttttgtcgccatcagaataagtttagccacagttcaaagtggcaccaaatggttaacagccatttgagccatcggtagatccattccataacataattaacataagcctatttttattgaattgaacagtcaaaacaggtactattgtatagctataaagagagcgtaaagacctaatacataaaacttaagtttcttatagaccaacaccttctgctataatctaagatcaaagagaaaaagttattttcccctaaaattcaaaagaaagtttacaaagagctttataagcaaagaaaaatataagttgctctaagatattaaatgtacatgatttcacccacttttgtttaaaataaatgtgcagcatattaaacaaaatataaaggaataattagtagtggcagaatgcatcacaaagtgctataatctttatgttgtaagagcatagatattcttgaactctgttcttaatttcgatagaggaaaagacatatcttctgctgtgggaaatatataaatttacagccccctttacagaatttatttctacttttgtttaattttatttatttatttatttatttatttgtttgtttgtttgtttgtttattttgagaccgggtctctctctctgtcacccaggctggagtgcagtggtgcaatctcagctcacagcaacctccgcctcccaggttcaagcctcagcctccaaagtagctgggactacaggcacacaccaccatgcctggctaatttttgtatttttagtagaaatggggcttcaccatgctggccaggctcgtctcgaactcctgacttcatgatccgcccaccttggcctcccaaagtgctgggattacgggcatgagccactgcacctggccacgattttttagtatatttctccttggcatttttattgtgctgttgtgtttttgcaccacaaaataaaatgaagctggatagagccaatctaataccatatttagcctattgacaagaaagttttagatttagaccagggtcttctacaatccaaattctccaagagcaatacgggaaatttcagggtgatgagcaaggttgatgatttctttgccatatgactgggaagtcccatggtttatcaaaatatctgttattttaacattatttaacatatcagttgccattgctaatctgaagacttcatgttcagtacgaatttgaaaatatctttattttatgactatgcaagtaagagaaatgaaaaagcctggattcatatcccaatactgccacctattagctgaacttaaacggtctctaggcctcaattttctccatctgtgaagtggagataatgatgatacctacatgtaggcaggtagggttgctgtaaagatcaaatgaagtaatttatatgataaatatattatctagttctatataatattctatagataccaatggtgattgtttgaagaattatttttttatctttaattgctcatttttaaaacgtatttgttccaacatttgctgggtctcaaagccccaattttcaaaataataaaaccacctactgaggattggattagtaaattttcaagacctctttcaaatttcccagcgtgtcatttttttctttgaattcaatatcacacttaaatgtttaatgtatcatgtttccatttagaaatgtatcattgtggaataaaacacaactttcacttgtttaatatgaccttaactctcacatacctcaggctttgtataaattgttcattctggtccagcctaggggatattgtagaatgctttacacactaactctgaccatttaaccaatggttaataaatctataatattcagacctgtcaatcttatagtttaagatgcacagaatccatttcagaaaccatataatataaggaaagattaaaatcttcaattaaatctttttcctggtgtctagaaggatttcaaactcagtaaacagtcagatgattttgacttgtgtataatctacagttgattttattggaaagtacctcatgctgtgttttgatttggataataaaaacatgtttctattcctgaatagtcacaaatatatatattttaaacagaaagaaaataaatttgtaagtggagattgtttatttgctcacaatataaagagttttctaggtattcatcatactccctgccattacaaaatgactacatcacagacagagctgaataatgggcaaaacagtccatgcctgcagttcccaaacctgaatgagcattagaatcacctaggaagcttgtgtaaagacagattctcaaccccaaatttactgaataagaatctcctgggatggagtcaagaaatctagagctttttaaaaactccacatatgactttgatgtgctaccaagtgtttttgaaatagtagcccagaggaccaaggaacagatctaggtattgctgaaaccaaatgattctgggagaacaatgtttgactgggtgtgtagtggcgtgccaagactagaagagttaattgtggaaaatggcaagccgctgaagggaaaacagccacgtgacagcaatgatctctgcagcatgaagaaactagtaactagaaagctttacctacccatccaaaaatctaaaaggaatagatgtgatttaccaaaaacatggatcacactcaccaagtgagactggtgaattacaataactgttttctctgaaaacatgagtccgccagtttctcttgaatgtctaaagcaagcttatccaacctaaagcccaggatggctttgaatgccacccaacataaattcaaaaactttcttgggatctttgcaattatttgttttagctcatcagctattgttagtgttagtgtgttttatatgtggcccaagacaattaatcttctttcattgtggcccagggaagccaaaagattggacactcatggtctaaagccaaaatactggctaaattgtatttgtttttttaaatatgcatttttttttttgtggtcagtgtgaacagagtaaccttagacaggtaagctgctgggaaaaaaaatgtctatgtggttacttggcaactgaaaaattacctaagcaattaactgaattttcagttttcaaactattgttctaatgctataaataaactaagccttagtacatgtttataagtcctactagtgaaagggtaaggtctagggaatagtgacaatacccaggggaagagtacccgtgatactgataacaaatgtcgtgtacatacgttcatattacttggtgtatttgccatttgttaaattcctactatatgccaaacactgataagctccttctctgccttacctcagttaatttttatgcaaacgctagaagacaggtaataatatcattatccccatcttaagataagaaattcgaatctcaaaaaagtaatataatatgctcaaggtcacactgcagagccaggattcaaattcaggtctactgtctgctactgccttttaagaccagttcctttctgtctttggcttaacccttaaatccaaatcgacttttcatttcttgaccaaagtctctcagatttatgatggatcaactatgatgtttgaaatagtagcccagagggccaagaaacagagctgggtgttggtgaaaaccaaatgattctgggagaatatttttttttaattttttttcttttattatactttaagttttagggtacatgtgcacaacgtgcaggtttgttacatatgtatacatgtgccatgttggtgtgctgcacccattaactcgtcatttaacattaggtatatctcctaatgctatccctcccctctcccccaaccccacaacaggccccggtatgtgatgttccccttcctgtgtccatgtgttctcattgttcaattcccacctatgagtgagaacatgtggtgtttggttttttgtccttgtgatagtttgccgagaatgatggtttccaccttcatctgtgtccccacaaaggacatgaactcatcattttttatggctgcatagtattccatggtgtatatgtgccacattttcttaatcctgtctatcattgttggacatttgggttggttccaagtctttgctattgtgaatagtgccgcaataaacatacatgtgcgtgtgtctttatagcagcatgatttataatcctttgggtatatacccagtaatgggatggctgggtcaaatggtatttctagttcaagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgacttgcatttctctgatggccagtgatggtgagcattttttcatgtgtcttttggctgcataaatgtcttcttttgagaagtgtctgttcatatccttctcccactttttgatggggctgtttgtttttttcttgtaaatttgtttgagttcattgtagattctagatattagccctttgtcagatgagtagaatgcaaaaattttcttccattctgtaggttgcctgttcactctgatggtagtttcttttgcagtgcagaagctctttagtttaattagatcccatttgtcaattttacctaggcaataccattcaggacataggtatgggcaaggacttcatgtctaaaacaccaaaagcaatgggagaataatattttactgggggcatcaaaaccagaagaattatttgtggaagtggtgagcccctgaagggaaaatatccacattgcaacaatgactttttgcagcgtgaaggaagtagtaaccagaaagctttacctacacattctagaaggaatagacgtgacttaaaaccagattccaggtgtaggaagattttagttaggtgggaggggaggagagtcacttctcaaattgctgtaaagagatcatccaaattctattttaaagccttggtaaatattcccctgtctcccatgtaaaccttcatccactttaccttattctttcttgataaatgtcagtagtaacattaccaaaacactctaagctctagaaaatcaagatctctagccttttgtgtatcatttgaacctctaaatcaggtgacatacaaacaacatatccttataaaaattttgctgaattaatggaggaacacaatggtgagcgagcctccacaatttattatgcagtcaaatgtaaattgtggatatcctgccatttaaaattactcaaacatttgattttctcttaaagtcatccttcgtctacattaacttaatcttaaacagagacatacacacaaagagagagagaggcagagagacagagagagagagacatttcttctttaatgacaaacagagcacatacacatattttccaaagactgcatcttgtcttatggatgtgcaattttttcacctttcagaaaaggtggtattgttttctaacatggaatgggcttcactatttagttgtcctctggccttgggcaagctgcacaatgtttctcaaattcaggtttctcatctgtacaaggagaaattaaatgcctaccttatattgttatatgaagtaaatgagatggcatggtaaaactccattattgtttgaacctttaggtaatgtaaacaaccttagattattcctaagcattccctctcaccttttaccagctctcaacattgggtcaggacttttgtattcatattaaagagaacatttatattaaagagagcaaaggatatatgttaccttaataggtgaaaaattatggaaaattaaatagcaaatgcttcatggaacataagtggtttactcagaatgacaatggagatagatatccctgctgtttaagaatctaaacattcaaaattatttaaactctgaaggtaataatgagtctttctaatttatcgagatgatgactatattttgaactgttctagcccttaatcatgttctaattaacaatgccattgcatttaacacatactttttctcactaaggatggtgagtcatttaggtttaacgtacaatatagaaatactggtgcttttcctttaacattaatatcttactccattaaagaaggaattagcaagaattctactgataaataatttttattaatattgctctagaaatacaaatttttttatttatcattttgattaaaggttagctggccataatatggtctatttatggacattagacatcttggcattcagttaactcatcagctgcagtgtattatttcagatactatgcatttaaagtcaaaatttacattaatctttctaaaggattcacattacattaattgggatgattcaacattgacagttgtttcacttttcttaacttataaatgcaataaccaaatgacaaggagtggtgagtttcagaagaaaatgtgaaactcacttcagtggtttgtattttattttggatattttaaaatgtatctttcattactgagctttaatatatgctaggcattttgctaagagattaacatatatctcatttagtgttcataataacttaatatagtatgtcctattgttttgctcattttactaatgaaaaaggtcaatttagacactccaagctattttctctaggttattcttcaagcaggtgtcagagcagggctgaccctcatgggtgtgagtccaagtctgactcaaaactactattctatattttctcaatatttttccacctaaacgtgcggaaagcaaatgatttttcatgagttctactgtaatcccatttaaaagctaaaaaactgatttttgctttatatataggaagtatgaatgaggacaatgtaattcaggatcagtcgacccagtaacccaatagaataattttatttgtggctcaaaacttcatgagatgtaattcatttgcctttgggtatattgattcctctagtcatttaactaacgtggaaattatttctgagccccactcaggggcaaaacatgatgctggacaccctaaaagttacaaagaggaatgagacactgtccctcttgtcaggaaccctaccatctagtaaggtagaaaagacataaatgataactattatacaaccaatgttaaatttccatacaattggtatgaatgagttcaagagggtcccgttttacttctgttcccccaaaaaggcctaatcaaggtttccctacctatacagtggagaatttagctcgatttgttaaaagcaccatgttaagtgcaaccaagtgttttgaaacaaatgcctctatcaaaccgaattaatagtttttcctcttagaatttttcctgttccagctcctaaaaaaagacttaaaaaggattattgattgacttgtcccattgtaaagtatgcacctgctgtgaaatgaagccatggagaaaaatagttgaataatttaacttttttatttgtaaagataatcagggtttttctgattacatcttaacttcataaatgttaaataacctatcagcatctagttgttgtaaattatgaaaaggagcattgcaaggaatattaaccaacgaaatccttgttctttagtgaacaagaaaatgtgttatggcagcttgtcattgtgcgactggtaactttgacaccaaataacaaaactgccatttgcacttagggtaaattggttcacttgagcttccactgctcctcttgctctgacataaatttatgaactcaggaactaaccaagtcgtgtggcttcccagctgactttaacaaatatgcccatttcatttcatttagtcatcagaataccagggggctcagtcatttcagactcattgcagatggtatagggtttgtaggaacaccagagactttcgtgtcacagtcctggaaattatgatagtggagggggcccactttcctaaatgcatgccagtgttttacgtgttcacagcttagaggagcattttctgtttcagcacctcataggtatatgtaaaggacatttatttccaattaatgaagaggtgaaaaatacattttctatgctcatggtttggctagccatgtttaaatctggattaagattatgtttatatttgacatgcggtagaagcacagttttgttccttcatcctctgggagtcctgtcctttttataacagaagttacttcttgaaggatgcaaggcctggaagcagaacagtaggtacagactgaagacataaagtaaaacaacctcagatgaattggagggaacgccactccaaattactgctaacaatgaataatacagtattttcgtaggaatgcaatttgatcatatccaagtacacataaaaaataaaactagataacaaaatagtgttacaaagacattaacttgaatgaatgtaacatttatttgtagttggaatagcaactttatatgaaagatggattcaaaagtgtttgagggcacatggaaacagtgccatagttgttttttgttctttatttcattttgttccattttgtcttgtagagatgtcagccatttattaagtactttctatgttatgggaatatattgaaaggcttacagatattttctaatttaatcctcacaactctctatgaggtagctattagtatcatcattttacacatgaagagacaacatccatagaggttagttaatttgccagtggtcgcttgggaaataagggcagcagaaggatttgatctatctgacaccactctgtggtttgtctagttcaacaagaatgatggcatgtttcttatgaatgtgtgtctgtcaaacttttctgcaagaactgtcctaggaacaaagaagacaggatgaatatgcaatcccaggaggtctgaaaacagagcctgaagcaatcatcattagcttgcagtttctttaaggtcttgctttttatcttaaaaattcatgtaaatttgccattgtattccagtgtttgtcttcatccaaaaaataatatattatacaacttatcatttgggaaaacattttctactaatctcattggctaaagagtgataatgctgttatatttcatgatattaggaagatctaaagaaaactaagcccaataacaggttcaaggtcccggcaattcttcccctcttcattttgtcataaatatgtgggttcaccgtgaggcagaggttgcagtgaaccaagatcatgccactgcactccagcctggtggcaaagcaagacttcgtctcaaaaacaaaacaaaacttgggaggccgaggcgggtggatcatgaggtcaggagatccagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaccaaacaaacaaacaaacaaaaaaaaacaaaaaacctgtggcttcaaacaacagccttttattcctcactgctttactgttatggcagggtaacaatagggagaaatgcccaaaatgtgatatggaatgctttgtcattctaggatactctggatggaaatttctatcagcatatcctcctgctgaaggtcaaattgcaaactgagagggtccccgattccttcttcaatctctcttaccacctcaagcaacaccctccaaaaaatactttttgcggagaggaagaagaaacctgattatattactttttattttacctctggcacagtacttaaatttttctcatccattaatgaactgagtctcaaatggtctctataatcaattctccttatccagctctcaaatttcattttaattattgcagtcttgttgagagcagtaaaaactgccagttttgtcgtggagtggtgaattaggcctcgaagaatagcctttaaataggcctattatgtgtattcaccataccagtaaagagaaaaataaagttattttttaggcatttaatttttgttatgatatcttttcctgtttctttatggagaaaaatagtatagaactctttattacctgaaacaaagtggaagtgtcatgggtcaggccaacttttcatcccatgtctagggtagaaaatccacattgagttcactttaaagcaatagcgagagactaacattacattgtcctttggttacagtatgaacagttatacttgttcagcacactggcacatcagcataaacattttcttgtgtcctacagttggttcattctgtggtgactacagagtcttcaactctacaattggctagcaaaaattctaatcactcaccatacatacaattctctaatcttgaacttttagaaagaaaaattcacacccaatttttgtgaacaaagaaacggggattctgctggttccccttcctcaaacagggaaatcctgtgtttcccaaattttccatatcaaagtgatactccaaaaaaaggcacagtaagtccttaaggtcatgataggttcttggaaactgcaattttgagtcaaaagatatataaggaaaccaattttaccttaggctagttgatataagcaagatttaagttgcaaggaatatttgtggtcacaaaaacgtcaccaaactaaatatcatcaaagaaagaccaaaacacttctaatattaaactgaaataaatatgagctatacatacatttaagaaagattaatagaaacaagtaagatcatttttaacctaagttttggcaagtcagcgagtgacaacagccatagggataaatgtttttgagcagaaattagaagaaattcttcttaccaccatgcactagtaaaaacaatcgcaagtagggcaagctcacagaaggcttttgtacagcattatttattattatgcatctatatgatagtaacacacttaatgaatctttactttacaattattcattcattcattcattttctgacacaccttttccagttcagggttggggtggccagggcctaaccaggcagctcaagaccattccgttacagggcacacacacacacccacactcgctcagactaggaccattcagacacaccaattaatttaatggaaacatctttaggatatgggaaaaatccagagtacccataaagaaaccacgcagacatggggagaatgtgtaaatttcacatagacagtggctccagctgggaatcaatttttttcctcataaatattaatgaaacaatgttgaatgaaacaacattattcgaggacctacggtactatgtttgttcctgtctttgaatatactttgacatgagcccacaaacctccaaagcaggtgtatttcaggttgggatacttggtctgcagaactttaaatttctacctataatatgcttgttccatcagtaatgatttttacttatccatcatttgtttccttgcttcggaatagtctccaagaatggctctgccttactgcacaaattttctcaaacctatcttgtcatttttccccaagttgtcctactctaagactccattatcaaggaaaagcataagtatattgatataagtgttgatatcagatgggcctaagttcaagtccttgcttctccaattaatcagtgtgcaatctggaacaagttatttaacttctctgagttttagttttctcatcttaaaaaatagtaatatttaccatgcagtattgtcttgagggttcgttcattcattcaatcagctaacatttattgagctgctactttgtgctaaagtctaggcagtggaaccacattggagaaaacaaagtcctaatttatacggttgacattctagtagtattaaatgggataatgcgtgttgcctggcataacacagggatgcattgaaatgactcttgtttgtactacttctgcaaacattgtaagactttcaaactggtttccctatgtcttgtctctcatgtttttaagccactattcatttcccaacagtgttatcattctaaaatataggtagactcttattttcttatttatacctgcaaagtctccttgttgctgattatatatgaagcccaaatttctcaaagaattaattgataaaatttagtagtcacttgagttttggagtgaagaaggcaggatccactctaaaagtcttactctaagatttccatcctaggaaaatgggaagatggtattatgacttactgaaagaggaaacctaggaaaaagaacaggtttgggagtggaaaatacagctagttctgttttagaattgttgagatcgtggcctctgaggaatatccatgtagaaatacctagcaggctgttgaaaatacaaagctgtaataccggaaagatagaaagctagagataagagtttaggaatcaatgatagaatgttagtagtttaacctactagaataaatgtaccagatagtttagccatgatgctctaaatttaaaataaacattctcagtctaagctgccaaatttaacgcaatctagcacctttcctgaggaagcaattgatcagtacttctgaagatgatcaatatctccttcagacacctctttttcatctatcctacacaaaatcctgagcatctttggtttgtaccagctcttccactctgtaaatacagaggccacatctataaaaagcaaaaccacatttcattctttagacctcatctctcttaggtcattgagtcctgtgcttcctcagtaatgttatctctagattccactgtttctaaagtaaagatagacttatgtgggtactacagaagtaaataactaaactcataaatgttaaaaactctcagatcaaggagacaatgtaatagaaaatgccattatattcttcattcaaaactcatatcctctccttgaaaaagtatgcctgttgttcatgaccaaataaaacttaacaagcatttaattatataaatagactttgacgaggctaaactgacaagacctactttctttaggaaggaatggtgaaaaatgacaattgttgaacccaaattttcgctgtatttagggccataagtctcactgacagtgaactgtcctggcccaataattaatgcactgggaattctctaggtagaccatgatttggatatttcatgggctatgtcaaggatccatgtcagacaggaggcatacacaatgctctacagaaaaattattgtcacaagcaaaattggtgttgttttctatgaactttaaaagtaagtaaacctagaaaaaatataggacagcataattgccttatatgttttaagtgaaatgtgccttcatttttatttgccaatagagtatatctttaaatagaaatattatgcttttaaaaatagattatgtacatttcttacttttggaatacacaatctaatatttgccaacttaacttttgtgaagcttttaattgctatattaaaaagtaatttacttttctattacaactttttttttttttttggaggcggagtctcactctgtcgcccaggctggagtgcagtggcgtgatctcagctcactgcaacctctgcctcccgggttcaagcgattctcctgcctcagcctcccgagtagctgggattacaggcacacaccactatgcccggctaatttctgtatttttacagggtttcaccatgttggccaggatggtctccatctcctgaccttgtgatcagcccacctcaacctcccaaagtgctgggattacaggcatgagccaccacgcccggcctcaattacaaaattttaaatagacattatttttaaaagacaaacatttgttgcccattctgttttatttatatatatatgtgtgtctatatatatttatttatatatatatgtgtgtctatatatatatacacacacacacacacacacacacacacacatatatatatatatatgtttttaatgttctctctctctctctctctttaaagggatcctcatccccgaaattcctgtggagtacaatgtcttactcaatgatggaagtgtaacacctctggccttctccgttggtcatcatcaatccacccttctggaaaatttgactccattcacacagtatgagataaggatacaagcatgtcaaaatggtgaaagtctttcagacacttggcctgggcttttatgaaaaagtatttcattaaaaaatttcattaaaaaggaatacattctcagtccaaatataaagactaacgtttcacttcttatttgtagtggactgtttacccagaaaaatcacagtctggcatcgagtaaagcattatgcatttctgcacattaaatcataaatatttaaatatattaaaatggtggttttgcaaagtcttgttttataaggccctttgaaagaaaaacacctagctcacataaaggagtctttggtaatataaaacaaaaatgagtattccaaatatttcatagaaaacatatttaccttggccttatttaaattttatccaggaggaggaagtgagaagttatttaagagttgaattacacccaaatgaatcctatatattttatagtgcttccttgaaccctattcatatatacaaactatcaccttgtgtttcatggcttaggctgtggtcagtgaaattttcatgtatctgtgttgtgttaaggaaaagcctcccccatttcctttatcactccaaacggataagtagctaaatgtaaactgtgatttaggaggggagaacagggaatcaagagagctatacatcattttatttatctcttttaaattaagtataaactttaacagatatggatatgttatatatgtgtatatcatatataacatgatatatgtgtatatcatatataacatatgatatatatgatctcatcatatatgttatataacgtataatactcatttgctaaataaagaaaacatgtaacttaccttagtataaaaaacattttgcttcaccttaaagaaatttatcagactcaatgtgtagtggaaactcctgtattgaatgtccttaggaatttctgtttccaaatagtgctagttctcatggagttggttagaattatgagtctgcaattttgctctgctgaactcatcagaaatggctagtcagtttgtccttttttctctaaaaaatagaccatggcatttttgtttgaggggtattgctttctctgatctgtcttcacctgataaacgtgaaaataattttaaattaatgttttcttgactcaagtacaaagtcaacgtctgcatctccgtgtccctgaaactgtgcaatggaggtacaatatccttcaaatagattgttttattcctgtgtgtttgaataatgttcatgagtttaaaatattggcaaaataaaatattattaaaagcatgcaagatgtgtaggtcacacatacacttgtgaaattcaagtgcattatcactttctggttagaatgactataataaactagagaaacttgagttcagacaagtttccttattattccttatttccagacaatatgccttattgtttatgtctatataaatatgtgactaattaatgggttttccaaaaataattttctatttaaatgttcaaatcccataaaaatttatttaaaacacatgtacaagtatatatgcaaaaggacaggttaaaataattttcatgatatcattacccttctgtatgaatatgtagttcttttccttgcttgaaaaataataaagacctcaattttttttttttcaaggaagttgtggagttagcagtaggatgtttgtcaaaacacctgaagcagccccaatggatcttaattctcctgttcttaaggcactggggtcagcttgcatagagattaagtggatgccacctgaaaaaccaaatggaatcatcatcaactactttatttacaggtaagattggctgttactattatttttagttatttaagaatgcgtactgctccaacacagcagaatcaagagcattttatatttccataagagaatgaatgggaattcatgttgtgtttttttttgttttgttttgtatgtttgtttgtttgtttgtagcacctaccagtgaggactaagactggtgctcaaacttttacaaattaaccaaggaaaaaagccataactgccatataacatttttgattgagatctgtttgaaaactgagaccttatagcccacataggcttatatttagtgatggggcagaacagtcctctaaagcaggggttcctaacccccaggccacagagtccgcggcctgttaggaaccgggccacacagcaggtgagtggctggtgagcaagcattaccaccggagcttcacctcctgtcagattagtggtggcattagatactcacaggagtccaaaccctattgtgaactgcgcatgtgggggatctaggttgtgccttccttatcagaatctaatgcctgatgatctgaggtggaataatttcatcttgaaaccgtacaccctaactgcattgccccagtgtgtagaaaaattgtcttccacaaaaccagtccctggtgccaaaaagtttggggaccactgcttaagcagctcactgaccaagaaaacatagtctttccagagaggaaaccagatacaagacaagaattctaatatttctcattaattattatgtagagattaaaaagttttttctcctcctccaaagatggtgcttttcataagcagaaaaaggggctctcctctccagttttccttctgttttaatgagcctccactccactggttagatggtgttatagcaacttgttccatcatgtgcagaatttattaagtgtacctacctaaaataaagaaaagagacaatagggaagagaggaagagaaagattgaggaaaaagagagacaaagagagattgagagagagagagagaaaataatggaagagagagatacactatgaacattttggtttgaaggatattttgctctctgatctagtcttcaccagatcaacatgaacattgctttaaattaatgtattctttaaataaataatgaatgaggaggagaaggagcaggcaaaggaagagaatgagggagagatggagggagggagagaagaagagaaaaaatagagaaagtgaggggaggtgagtagaaagtacaatgcaaagagccaagggggcaaataacctgtcaactgatggcttgctacttaagacagaaaatacaatcattggtagacatacaggacttgcagattgaaaaacccaatcccattctgaaagcaatgtatttcctttagcgtacaaagcagaacacccttcttctcagatcctcataccccgcacctcttcaacatcctttgttagtgtctctagcagcctcaggccttcccttatttggtcctatgccctggaaacttagtgaaacttacttaggctcctcttataactttagatattgaaatcctttgattcacatcagtcttcagtgatgagctaagggcttatagaaaaaaattacgaaaggagaaagtattattgcatttctggttatgtaaatgacattaccaaaaatgaacaagccaaatttcttctcagcaaacattaatttgaagaataatatttctgattcaaaaacacatgaacacgtaaaaatggttaatgtgaatttccattttacgctaagcacattagtgcaggctctaaaatgtccaccctcttgaaatagttttctttcatccacttaatgctaattgcatgagaaaagcacatcaaattcctattcagaataaagggaaatagagtatctgttatagaccaggacgtggcttcactctgttggttttgtaaataaagctcgtgattacagtgcctattccatggcagctatagagagggaaaacaggaaatataatgcagaaagcccgcttcaatgaaaaatactgtaaattgaatttgacagcatttgatggcatctgattattctaatcacagccaaacaatgatataaagagtaatatgaaacagaatgtgttactgcctagcagactcaaaagcaataaaccttcctccaatgtgacacaatcacttcacaatcataattgtagcctgtttgatacctctgagtacagcagaagggcactgactgacatagatacattttgttttttatttaaagtgaaatgaaaatggcgcactggggctccagatacaatcgttatattcacctacataggcatgaatcacttggcagttatttcaactgaagtttaaatgtgcttagacaacaacaatatcaaatttttcttagatagctgcaaaaaataatcagaaatttgtaaggacagaaatagaatggagacacatagttctttttcattctgagactacatagagccctttatatagttatagccaccagcctgcagtatttctgaggaggttatggcatgtaatttcagcttcatcattggccttctctttcttctatcggcaccaaaggaagtacatttagctcaaaccaaagataggatttggcctatgcagatatttttattaacttgcaggaagcccacttgtaaatctcatttgaaattgtttgccactctcttctcaccaagaccctgaatcattttcttttctgtaactgtcctttattttttaaatatttcctctagatattatcctattaaaaaatatctgacctaataaagacagaagatgtttatgacttcaaaaacaaagcaaaataacctaaatattatcctattaaaaagcgtctgccctattaaagatagaagaatgtttataatttcaaaaacgaaacaaaataacctagtaagaacaaactattaatatgattccctctgcttagtttatctgtttaagctattttgttgactatatataagtcacaaaaaaagatttgctacaaaaagttttgtaaagaatagagaccaacatttaagttagtgttttgcaacctgtttattgactgagtatagacaagactgtcttggacatctgcttcctcctctcaatgagtttggctggtatgataatgattcttcagtattccccctttattttatatctgcaaccttgcaaatggcaaaaatctcatcacttacgtctacaaaatccatcaaacacattaaattgagactttacaaaacatgtaataaaataatctcctcccactaggtgctttaattttaatagaaaccaaatttcatggggtttattattctcatgagctttctctttaaataaataaaaagatttgatcaatgtgcactgagaggcaaaactatatacaaacaccctgtaaatgctgtaaaaatagaaacaaatgatggcacttccttctgagtatttagtaagatttaaaggataaaatctgaaataattttgaagactgtatgatatgaaagggttttcaaagcagataagtgaaaacattttataaaatggataattaagctgattgaattaactaagaaaagacgagcattgaatcaaaggcaaaggaattttgatgtaattcaatttgtattgggtggaaagatggatatagatatgaatatttatatagatagatacagacagaagacagacagacagacatctacctatccatacatgtacatatctactgagagagacacaaagatctatgagacctaagcccttttaccaatgatcttcactacagtgggagatataagacaggctaaataaacaaagaaaagagtaaaatatatagtggaaaaacagaaatatttaccagaaaatttagagaataattctgtgtctagaatattcatggaacacttcatcaagttgatgtcattgagactaggacttataaaataaagatttaatgactatttaaattgtaagagaaatacatttgttagaaaaaatgttttaacagtacagaagattactaaggttattattcattcttatgatttactcatggcatatgtaattttcactaatagaagtaacactattaattttaatatattaacattaatgttttctatttgtattttcttcttcatgaaagaattatattgcccatattgttctgcaattttctttgggcattttatatatatgcccacacacatatacacacctaatttcttttaatgactcatcaatattctgttatatggatgtgtatcatatattatttagccagtaccctgatgatggcaagataggtgattttcaagttttcgttaccacagcaattctctaataaatattcttacggtaagtatacagagaattattcttagtactagaagtactgggtcaattaaaattgttgaggatttgtctttactagaccatatgcatttaaaattgttgaggattcctaagttgtcttccaaatatcatatgtaagaatttctaattctgaaatcttttaatacagggtcagtcttccaaatctgtcagctcaatattttcatttgcacatttttgttgttttaattcaagttttgatgattataagtaagattgttcatttacttaaaatatttatcttctatttgggaggggtatgtataatatattataaattcttagactaattttttctactggattatttcttattgtctatattctttccacattaaagaaaatctccctttcatgatcatattaaaaataacacattaattatttcttccagcacttttatggctctactccttatttctaaatatggaattaatattgttattggaaattagataagaattcattttcttaaaaaatgctaactagtttatcaacattatttcataatccactgatttgaaatgtcactcatacaaaattcctatgtgcatcgggttcattttaggactttgtattctgtttcacttgtggtaaatagggattttaacaagtacagcctgatggtgaagacatgataagtgaataaaatcaatagaataagcaaaatttccaacacataagcataggattcaaggaatggtcaggtttatctggagtcattgctattagtaggggacatttagaagatcagcttaatgatagattttagatctaaggagtttaggctttatattcagaggcaatgtgagctgctgaaggtttagggggtaaatagagaagcaatgtaataaagtggaaagagtgtggcatttgtagtcagaagatatggcttccagggcctggctctaacacttactagttatatgaccttaggcaagtcactgtgttccctaattttccatttttacatgaagtgaagatagtaaatataaaagataattagcctcttggaattctgtaagaattaaataatatgtgtggaattactgttaaatgtgaagcatgataaaaatagaaagttatcctagatatgttgtccaaagccatgttttagaaagacaaatccatctggcagttatagatgtacatttaaagtcaatgaaagaggttcatggttataaaagtagcagcttgcataacagtatgcctggtaggattctgttttcctttaaatatatagtatattttttacatatatatgtatataaaaaaatgtctggaatgttaaacaccaaaatagtgctagcagtgcttatctccaaatattaggctatcagtgattcttttaaatacttctgcttttgttcatctgtgttttcttattaatttttatagtcaatacatcatatggtctagtaaagacaaaataataaatttgtgagcccagatgcaaatctatcatcactgtctccgattttcctatttccttctttgtgtgaatatcaccatcactttctgtaataatcaaagtctgatcaagaaagaggaaccacactacttactttaacagaaggaatttaatataaataattagtaagtagttataaatttgttaactaggtaactaaaagcataaaaagagaactctaagatatcatggaggtggcaactacaggaaacagctagcacctttagaactgagggaacaaaggggagttgttagaattattaaaatgtaaatgcatagaggagggtgcctgtgaagctgggactcagacagttgaagaggggtacctgccactggtgcagttgtatggaggaggaaacatgaaattaagttggttttccaaatgtcggaaaaattgcatgctgcaatcacttgctcccaaggtatttctttattgcaacacaagaacagcctaatacagaaaactggcaccaggagtagcgtgttgctatgaagatacctgaaaatgtggaagtgactttggaaatgggtaacgggcagaggttgaaagagttgggagggctcagaagaagacaggaaggtgagggaaaatttggaacttcttagagactggttaaatggttctcaccaaaatgctgatagaaatatggacagtgaagaccagactaatgaagttggagatgcaaataattgagaactagagtaaaggtcacccttgttatgccctagcaaagaactaggttccattacatccatgccccagggatttgtgaaagtgagaacttaagagtaaaaacctagggtactggtggaagaaatttcaaagcaacaaagcagcattcaagactttgcctggctgtttctaacagcctacaatcagatatgggagcaaaggaatgactcaaagttggaacttttatgtaaaagggaagcagagagcaaaagttcagaaaatttgcagcctggccctgtggtagagagagaattcaagcagactgtggagtgaccactttcaagagagactagcatcactgtaaggtagccaagtgttaatatccaagataatagggaaaaggcctagaaggcatttcagagatcttacaggcagcccctctcaacacaagcccagaggcctaggaggaaagaatggttttgagggccaggcccagagccctgctgccctgtgcaggcttgcgaactgttccccacatcctgactactcttgctgcagctgcagctcgaagggcctcagatacatcacaggtaggtgcttcagggggcgtacaccaaacccttggtagctaccatgtagtgttaagttggcagatgcacagaatgcaagcatgaaggaggcttggcagcttccccctagatttcagagaatgtatgagaaagcctgggtgcccaggcagaaggctgccacaggggtgaagcccttacagagaaactctactagggcagtgcagaaggcaagtgtggtgttggagccaccatacagagtctccatcagggcgctgtctgttggagctgtgggaagggggccacttctctctaggtcccagaaaccatggacagcttgtatcctgaaaaaagccatagggattcaactccaatatatgagagcagccacagggtctgcactctgcaaaaccacagggttgaagctacccaaagccttaggagtcagtgcttgcagcagtgtgccctggagtgggacatggagttaatggagactattttggagctttaaggtttaatgtctgtcctaccaggtctcagacttgtgtgggccctataggccctttctgttagccaatttctcccttttgcaatgagaatgtttacccaatacctatatccacattgtatcttggaagtaaataacttgttttgattttataggcttataggtgaaaggagatgagtctccagatgagattttagacttggtacttgagacttggggcttttgagttaatgctgtaatcagttaaaacttcggggaactattgggaggacatgatttcattttgaaatgtgagaaagagatgagatttgggaggccagtggtggaataatatagtttgtatgtttgtcctctctaaatctcatgctaaaaacagattcccaatgttgcagatggggcctagtgggaggtgattgcataatggggtcagatcccttatgaatggtgtagcaccatgcccttagtgataagtgtgttcttgctcagtttgttcatgatgggagatctggttgtttaaatgtctaggactccacccgccccccgcccccccgccacctctctctcttgctcctgctctctgcacgtgatgcacttgctctttcttcaccttccatcatagttgtaagcttcctgagtctctcataagcagatgccagcatcatgctttctgtacgccctgcaggactgtgagccagttaaatccctattctgtataaattagcttacctcaagtatttttgtagcaatgcaaaaggagcctaatacaaattagaaaaaagaggtagcacatagaaggatatgataactcttatttgagagaaaagcaaggaaaagactttctggaaaaagtgatatggggctagaattttaaaagacgagttgtagttagtctatagaaaaaaggagaggccaggtgtggtggctcacacctgtaatcccagcactttgggaggctgaagagggcagatcacaaggtcaggagatcgagaccatcctggctaacacagtgaaaccccgtctctattaaaaatacaaaaaattagccaggcatggtggcaggcacctgtagtcccagccactcgggaggctgaggcaggagaatggcgtgaacctgggaggcggagcttgcagtgagccgagattgccccactgcactccagcctgggcaacagagcaaaaaaaaaaaaaaaaaaaaaaaaaaaagaaagaaaaaaggagaataagaaagaggattgggagggatattgccagagaattagcagataccaaagccatggaaccgtgaaatataatggaatataagaaactatagtcaagcatttgatgataactagaatataaaatgggactagaaatttcagaaaggtgagtccttttgagaatcagcagattaaggataagcataggccattttacatggtaaatctctaaagaatttttaaaaggactgtcttaaaatttttgaaaggtttgtgatgtctcttccctcaacagccaagtctctactcacaccaaaaacttgacgattcaaccttcacaaatcattttgtaaatcacctgtgtttccatttgtcctctcagcaatctagttcagggtctgcatttattcttacgtaaactgttgagatgacctccttgttcaatgccagatgcacatcatctccatgataacttcattcagatcatgcattacattttacccaatgatttttatgttttaatttttataagaattttcagaggtttgttatactctatgaggttattaactccactttacaaaatgaaatagaaactagaggacacagacaggcaagttcacccaaggtcattgaactaagtggcagagccaggacctccaacctatctcctctgactacagatgtttctgattatctatttaaactcagaatatttgtaatattcttcatggaatggggttggcagtttcataacctcaaaattgttatggtgcattgggttctaggattttgttttaattgcttttgaaaataagcagtgacaattgctggaggggagagaaggagtaaggagctcctaaaagcattgtacattgagaccacagaagtgtgactgcctttaaaaatatatggttcctagtttttatacttatttttgttttcctcttagtgttaggcaacattaaattaactctagttggaaaattacattcctgaagtatctcccaaatgagcctgagcaaagaataaccatttggctattcagagagaactgaaaatgtgatttctctaaacacaggctactcaggaggaaacacttccagttaaatgaacaggtgatgcttaaatcttaaataattaggaataattgtggtctactcaaccacttctgctctaaatgtattcagacataaagagagactctgttttttagcagtgcagatgggacatgtacttctccacgatattaatttttcaaggattcaatagcgataagaaatacttaaccaggctgcaccttttaattcttttggtgaataaacttgaggccaacataatactcaatcttttaaatagtatatgtatttaaaaccccacttttaggcaaattttgttaagaatgtcggctttatagaaaccatgactacatctcaatttgggaattcgtgagagtttaataaaaattaattgaattgtcatggaaaggctgaagctagacaaaatagaaaatgttacttccccatagaccatcataggtttgtttgctgtattgtgttcctagcaaacaactttttaaaaatcactgagaagagtccttggctatgagccctgcagttctcattagaatggatctctcccaatgacacacctggtacctgatatctgtagcaagtacaaaggccaaaccctgcaaaccttcactgagtgcagaatctggttcacgcatggtagtgagcaataatgaggtgggctgccgaaccataattgcaggtgactgagaggtgtctatgaagcctctatagcttccagcatgaagcttgtcattgctcatacttaggtcatcgtgatttatcaacttaaggatcatcagattcccaaagccaaagattttacatattctgcctttttgtgaaaggtaactgtcattcactttgtcttaataaccctttacattttgatggagctggttaatctgatatggcagcatgtgaatttttcagcatctgaagagtgtgttaattaaatacttctaacagcctggaaaatattactgtattcatcactctcttctcaactagagagagagctgaaagaggagggtcaatgtcttggttacattctctcccaacctggaatactgccctgataggaaataagagctgatggagaagaggcaaagatgcagggaagtaatgggattccataacttttagcctttcacttgaaaaacatgattgaacacttactgggctcagatgctgggaatatagagatatgccaaccacagttcctccagaactttgctttccatcaaacctgcatcatgtttttacatctggatgagaaaagaactgttccaaatgaagtatcagatatatagggccgtctcaacaactcaccattccatttctcttacttctatatttaatgctatatatatttagtaccaaaagagtatgcatttggccctagtttccctatcaacaaaatctaaagatgagcctaaacaattccatcctcagacagttgaaagaattttggggtcatactctgcattttaccaggttttggggaagacatctaaaaggaatttgacttttgtcctttaaaaatctctaaagcaagccagacatggtggctcatgcctgtaatcccagcactttggaaggccaaggccagaggcttgcttggggaagaccagcctgggcaacatggcaagacctcatctctacaaaaaaattttaaaagttagccaggcctagtagcacacatctgtagtcctagctactcaggagactgaggcaggaggatttcttgagtccaggagtttgaggctgcagttagccatgattgcatcaatgcactccagcctgagtgacagagtgagacccagtctcaaaataaataaataaaacaaaaaaactctaaaacaaattcctattatattacttatcatgttattttcattaatctgcacatagctccatcttctctactcagctacctattcctttaggtaaggggtgtgttcatctttttacccttgtttctaatacaatgatgggcatataacagtgcttaataaagttgttgatgtataagtacaataaatgtagaaaaaacagtggtcttgatgtataagaaaagattgtccatactttgagaggttatggtttaaattatagaagagaaaattcaaatgaagagaaattaagtggcatctaagaagtgaatttaaaatactttgtaaacatcctgggaacaattgcaaaagagcattgtgctgcatgagagaaaataggaactgtggacttcccttcatagttcttcatcatccagtatgccaacctgggctttttcacacagtaattttatggtcctaagagcagcaaaaggatcatcctcaatgtgcaaacacttttgaagtctctgcaatcatcatatttgctactgtcccatgagccaaaaaagtcatatagccaagctcagagtgagtttacgagcatactcgcaaaaggcctggatacaggaagacaaacacattgggaccctagctgcaatccatttatcatagaagggtaaggattcccaataatagcttctactaattccatatcctgtggttccagttgtacaaaaaataaaaccccgatataactgcatgcatacatgcacacacacacagacacatacacacagatctggaaaatatataaaaatgcattaataatgtttaatatatgcttctgtatttttaaaagattttaaatatgtttgttttcttgtattgcatatgtatcttgttattcagcaaaaacatctggaagataataaaatgtgattttggatgaggtttcaccttttgtgctttttatatttcttctgtgttttccatgttttctacaaagcatatgcactcttttataatcagtcaaatacgtgtgtgtgtgtgtgtgtgtgtgtcaactacactttaaaaatgatatggagttaggccactggagtacttctccatctggtttttctttactatgacaccaggaagaaacagctgaaaagttaagttgataacaaattctaaaaaaaatgtttttactccatctacaaactttgttttgaagtgtgcagctgtcactggttgcctgcttggtttcctttcagacgccctgctggcattgaagaggagtctgttttatttgtctggtcagaaggagcccttgaatttatggatgaaggagacaccctgaggcctttcacactctacgaatatcgggtcagagcctgtaactccaagggttcagtggagagtctgtggtcattaacacaaactctggaagctccacctcaagattttccagctccttgggctcaagccacgagtgctcattcagttctgttgaattggacaaagccagaatctcccaatggcattatctcccattaccgtgtggtctaccaggagagacccgacgatcctacatttaacagccctaccgtgcatgctttcacagtgaaggtaagaccctttagaaaagtaacagacatgcagattatctggtgaatacgttgaaattaattttcttgtccaacttctcatttttcttcacttagggcttaaatatatgaaaatctttcacttgtgaaaagttgcaatgtagtcacggggataagatactgaactgagtatgaggagtattggagaccagtttgtagaccacgactaattttgattacctcaaaaccaataaataaattttatttattcataaaattgcctgatttccattttccatatttactaagtgggaatattttttttttgagacaggctctcattctgtcacccaaactggagtggagtggcgtggtctcagctcaccacagcttctgcctcctaggtttaagcaattctcctgcctcagcctcctgagtagctgggattacaggtgcccaccactgcccaactaatttttgtatttttaatagagaggggttttcaccatgttggccaggctagtctcgaactcctgacctcaagtgatctgcctgcctcagcctcccaaagttctgggattacaggcgtaagccactgcgcctggcctaaatggaaataatttagtcttgatttccattttccatgtctactaaatgggaataatgtaatgctttcctccatacctcatagagatgaggttcagatgaaattagacagaatatttaattttctacttccccaacaagctagtataatatatagctatatatatatgtatatgtatatatgtatgtgtatacatgtttgtgtatatatgtatttgtatatatgtgtgtatgtatgtgtgtgtatatatgtatttatgtatatatttaaatatacacacacacacatacacaaagttgcatacactatggcttactggtgatttttttcagggatggcttcctctggcccatagaacgacttaattcagttcacctgagcacttagtagctcctgagtgctttctttatgtccagcataacctcatggtctatggaatatacagaaacaggatggtccttgtcacagggagtgttccgttttataatattgcagagatgagaattgcacataaggggaaaagaatgagaagcagttgagtacagcctataatgtccactacactgagacttagatcccgaactccactatctactagctttaaaccacagtacaagagagagtaacatcatataccaagtgttaggcaagaaatgctctgggagatcaactctcaaactgaagatgcttcatggataagattaaattttgtggtcttgggagtgaaatacaaatatgtgccaagaccttattaaatatggaaaaccctcaataagaacaaataaacagacaaactaaagcatttataaaaaaaccaaaaaactatgtttctatgctttaaatcctggaaggccaatttacatgaaggttatcttatggaggataacatttatcaaaatatttaaattacagtgagcaaatatattttcattaaactccagaagagcccttttaaattaatagtttaaagtacaatgttttcccactgtcctcatgtttaattttctcatatgactaaaaaataagcaatatgtaaatgaaaggataattgttttatcttcatttttatctgtttcagaattagtactatatttttattagatagtaaattatgtactagagtcttttatattatgtcttctagttcctatatgataagcattagaagcagtgttcttaagtgtaaaagatactttttagtggatatgtgatccaggaggaagttcgttacttcccaccatatccttcaaactcatgttctaaactttcacccttaaagtaaaacgtttatgagtatactgaaacacccttgttaatagctttctgaatgaggcaccttaatttaaatatgtttttattgaaggcatcaggattataatgattaaacctctgatcttttaaaatacaactttcaggggtaggagcctaataatcatttagtctcacgaaacagttctattggaattcccttgtggaataaccctgtaagtcatcccttcataaccagcttcattttaaaacacaagatttaaagtatatgatgaatccatgaactctgttctttatttaatcttctaggctctatttttatcacactaaaaagcttctgaaaagaggcaagtgtatggccccaagctttaagcggcacagggctctttgcacatgggccctccctgatgtggctttcattttgacagtccagtactggtgtgcttttctatttttccaaagattttttttcttgcaatgtcgaatagattagccagaataattttaaaaacaatacttctgtgtcctatttttgaatgtgtatgtgtgtattcaaagtggcctcccaaaacctaaatctttggctcttagaatttcaagagaaggcttcattagatacaccaagaaaggtcccacctgatcttttcaagcaaacaaggacatcttccacaaagcaatctaggcaagtgttcagaccttctggccactggaccacgttttcagggcatcagggcaactatgactctttatgatctgacacctttgaaggaagtcatcaggaaaatgaactagtgtttttgtgtttcacttattcccacagtccctgtgtaggagattgtgttcaatatttttgtttaaaagatatctaggccagacgcagtggctcatgcctgtgatcccagcactttgggaagctgaggcgggcagatcacaaggtcaggagttccagaccagcctggccaacatggtgaaaccttgtctgtactaaaaacactatttttagtatttttactatttgagaggctgaggcaggagaattgcttgaacccaggaggccacggttgcagtgagccaagatcatgccaccacactccaacctgggcaacagagcaagactccgtctcaaaaaaaagtaaaggaagttctattacttatccagggttctatactcctcaccgtcacagaagaatgtttcttttatctcagacaaatcctgcctcctataatttaagtctatctccctttgttcagagcagcatgacttctccataatagcacaaaggggcttcagggtccaacaaattattgacaattcaatctgatttggcaaataaccattgagtactatattcaatatgtcaatattgaataccaaacttaactatgttgttgaagtctactgtgagacttggcccttgagcagagcagagactgtgaggaagaatgagtgattcgttctgaggcacaggctattactgttgggcattttgggtttttaagcttcttgcagctgcgtttctgctgcccatgtttagaagaccccatttcatttttatttttgtataaacttaatgggtccaagtgaagttttgttacctggatatattgtgaagcagtgaaatctgggcttttagtgtaaccgtcgcacaaataatgtacatcgtacccatcaggtcatttctcatccctcaccctgctccctccctccctcccacccttccgagtctccagtgtctattattccacaccctatgtccacatgtatatattatgtagtcctacttataagtgagaacgtgcggtatttgactgtctgtgtctgagttacttcatgaggataatggcctctagttccatccatgttgctgcaaaagacatgatttcattcttttttatggctgagtagtattctacagtgtgtgtgtttgtgtgtgtgtgtgtgtgtgtgtgtgtgtttcacattctatatatatccatatatataattacattctatggtgtgtaaaattattcctatttagtaaatatggaaagtggaaatggaaatcaggagatatatagatatagatatagatgatatagatatagatatagatatagatatcacattctgtttatgcaatcatccattgatgaacacttaggttgattcaatatctttgctattgtgaatagtgccgtaatacacatacgaatgcaggtatcttttttaatataatgatttattttcctttgggtagatgcccagtagtgagactgctggattgaacggtaattctacttttagttctttgagaaatctctatattgttgtatattgagaaatctctataggggttgtagaagactccattttaaatcgcatcccaagtacttccctagatctacttactgtttatctaatttctgcaccaggtaaacaactttactgtcttctttcctttctgtgcctgctgtaggaaatttttcaagtttttgtttattggccactctggctaaaattcttcagggcaaaggaactacagaaccttctccattaatgaggcacagagtccatccccacaactgtaggattgcagttcagtccacaaactcgcaagaggtactgctaatgcattagtcccttgtttattaagatctcatctctgcccaaggggccatcaataaattgcccatgttgtggtgccatcactagcttgccccaaggtccccccagagttgtttatagacaggtggatgttgctgagagagccacataaaacaggtgcaatggaggcatgaattctgcttgtggtggcagtggatggagaactggcagtgggggccctccgtgggggtgagaagcgtatgtgttggcaggaacagcagcagcggcagcagcagcagaggcagcaggagcagagaaatggaaagagtgtgggttttaatgcatcactagctgctctcccaacctcatgaaaagtttcacctccctactcatctctatgtaggtctttctaaggaagaaagagggagatcaagattcttggggtctctttagaccaataccttccattattgaaaacagctttaattagaaggccttaaactcccttcccaattagctctgtgatgaattgtgcggtgtcaggaaagaaactgtatttagccttgcttggcatgcaggagttccatggtggtatttacagggaacactcctggcaaggttggcgatattgctaccaccatttgggtttgtttgctttttctcactggcatctgccattgtgctggcagaaataaatctgataatttgggattttaaagaaaaaggtggtttacctattatctgtgccctaactatatccttgcttgttccacggggttataaaacgtcaagcccagatcatgcatttgcccagtatcctaaaagataaatggtacttcactctgtgtagaatcaagcataaggtgctgagaaataagcaaattatatgggtcactaaaaattggcttccaatctgggaataaaatccagaattactaactctagtttctagattctagttgccaggcttcctttcccaatgtcaaggaggaggtagtcaaaatttcctcaagggtttgtttcctatatctttaccattaagtagatatgtggcaaaaataataacaataataataaaatagatatttcacaattgccatgttatgaagagtgtgtgagtaaattgataaatttatttttaatcccattttcattttggcttagataacataaaatattactgctctttacatatgatcttaaattagtttcaactctttttaatttgatgattcttagccttttctccccagacacatttattagacaacagaaatactctgggagatgtagctttctaaaaggactcctttggtgactatctttctaatgtgaagaaaaattcagtaataaaaataattatcatatttcctgggtcggttctataaactgagattttcacattttataataagaaataactgtgtcattcttctatataaaagatagaaaacatgggtgagtaaatatcacacaaaacaatgaatatttgtcggcctaaccctttttttttttttttttaaagagacagggtcttgctctgtcacacaggctgcagtgcagtggcaccatcatagctcactgcagccttgatgtcctgcactgaagtgatcctccctcctcagcctcccaagtagctgggactataggtgcatgccaccatgcccagctaattttttaaattttttgtagagattgtgtctcactaaattgccccagctggtctcaaattcccggcctcaagagatcctcccgctgcggcgtcccaaagtgttggaattacaggcttgagccactgaccatggcaaaactttttagttgtgatgatattttagctttaatatcaacttttcatttacttgccttacataatctttaacccttttgtctaatttgggctagacaaattagactttcagacaaatatgtatttgtctgaaagtcataaatacatataaagaatctaccttttgctcaacattattggggatgaaaaccatgtaagtcttttgaaatttatgtaattacatctttgaaagagccatatttttctccaaccactttatcccagcaagctccatcaggattcccttgctcacccatcagtaacatctaaggcaggtcccatgattttccagtcacttttcagtggcaaggatcaacgcaactggtgattaagactcattccaagtgttttttaaaaacttcagtctagactgggggcgatggctcatgcctgtaatctcagcactttgggaggccgaggtgggtggattacctgaggtcaggcgttcgagaccagcctggccaacgtggtgaaatcctgtctctagtaaaaatacaaaaattagccaagcatggtggctggtgcctgtaattccagccactctggaggctgaggcaggggaatttcttggacccgggaggtggaggctgcagagagccgagattgcaccattgcattccagcctgggtgacagggcaagaacctgtctcaaaaaacaacaacaacaacaacaaaaactccagtctaaattaaaacctgatatgtgcttaaggatctgcagtggggaaagagggcatggtcattttcctctttcttcagttccctcttctcttatttatttccccaggatcatggcatgaaaagaaagaattagacaaaaaggaacagagctttactcaataatattgctctaattaatcttctattaattttgagggggcagatgcctcatgggattttctctgtgggttatataggggtccccataggaaattccatgcctcatagtcctctgatgcaggcaatacactctctggctaatttcttactatttgttattgtccaagaggtccaccctacaacctttttttgcctctgggggcccttctcccaagcaggcagccaatatcaagtcctatcacgttgacaaaactcattcctttcttggcacccactaggattgcagaaaactttggtttcaccaaataatgaaggtacagcttgtccagtactatattctctgcttgacctatcatgctggatgaaacctagccagtctcctaactttggaattcattgactaagacacaggtattagcttctgtgctagcctattatcccaaaactatgggatcacttaaggatttcagaagacccttttgactctagtcattgcatcaaaattgtcctatgaatttcatcagtgcagtaggaagcctcttgccaagaccagactgttcatctcacttttctggcaacactcccaatttcttcaagagcttctcttggatattccttgcatgccttgaaaggggagtgtggagaaatcccattccctccctgaagtgggaaagatataaccaaagcctctttcttctccactgaatccccttctttaattttttttatgaacttggatcttctcatataggttgtctacatagatcttcataggaagatggatcttgaagtctgttttttccataagtcatgcagtgatatgtctagctgttccagtagagttacttaccacctatttttctaaatcatactcattattctccaatacagttctgtttcacatcctattatataactaaatggccctatcatctttctagttgcacaagccagatcatttttgagtcctctctcttccttacttccatatcaattcttcactaagtgctattgattctatttccaaaccatatcttaaatccttccacttgaagacaacattaggatcttcacacatgttaatccctcctcctggaatgatggctcattctcctataattcatctgtcctcattcttactcatcaagtctgaactaaaatgttgcttatctcatagggctgctgcaatgactaataaattaatgtatatgcaaagtactgtaaagggcaatataaatagactataaacctttagcagtccttctttttgaaaaaacagagactggaataaattagcaaatgtagataaggttctggtttgtctaggcaactgtactaatttggtcatgagtgaaaaaccttatgttttatacattttaagtgttcctcaccttgcaataaaattctgagcttgcaaatttacatgtttcctgataccacattgttaatttccctgtaattttccaaatactggattaggttctatttcctttctaaactgcctgaagcaagaacatgctttttttttttttttttttttgtctcctgaggtttattacggtcttatccctggcccccctgccccaacaacatcacatacctgccagtctaagagccctcctcaggagatttccaccctatatgtagttctctttacctgacatgacactcttaggaccctaccctttcccttagatctgggattatatcagcagaacatgatgaggtattttagtcacacacacacacagacacacactctcacacttctcaaatcatacaaatggattctgccaaattggcatctacctacttcccctatgccaaatagtagtttatcagtacatgagggacagttagttggtggggagactgtttgacctgtgagtcaagtatgttgctattttctggcctttaaccaacttacaaggaaaccctctttagacacctaagactcccgtggagccttgtcaaaaatgtctgtgaaagtaaaatgaactagtccacatactaacaggcccaggccataaattcagaatatatgccatttagcagagacagcaagctgtaaatggcagtgaagggcagaagttaattgaactactctgctcttgtcacagatggaaagtagccactacctgagacaagatggctgccccgaagtaccctattacagccaagagatcatatccttagctctgcaagggcttatgggtgagggggaaatcatacacagatgaccaatttttttatggttcacagccgataaaagtgaaattcagcagctgttcaggacaagtgaccactgtaacagctgtaatataacctactaaatagagagggaattgcattagagcaagaggttagctgtgatcatcggcaggtgagtgctttattgaagttgaaagaccattaacattgatagagtaattatttcaacttgaaagtaattaccttgatgggtgataacttctctagtgttcccagatttgattgggccaaacaattgtgagctcctgaagcctagaaaaatattacaacaatactgtgatttttaaattactgaaaccactgttggaatattctaattatgccgaacagtgaaaagattttgccttacacaagctagtgacctctcatgtagagagagacatttgctttttaatccaaatgcaatgacccacacccaccacctgtgaatacatatgtgatgggtttgcaaatgaatctttttatctcaatataatttttaaggtgaaacatcttgttagtgctgtgcctgggtaatagtaagctagaactgctgacatttttgatcatatctatggacttgaagtctccagaatggcaactatcttctatctttgtcacagagggtttaaatttgtataaattaaatattttgataatgactacacataaattagaatttctggatgccacgtactttggatcccaaatttcagatattatctagttacataatcagttgtttaaataactttctcgcctgatgttatgcaactccactacaaacactccattgtcagggtattttccgtttacctacactggacatcagcaaacaaaattaaagttgaaaacctgggctattgcttctctgtagtctcatgaatatatgaaaattgcaagttatttgcaattgagggccaagacacatcaaatctaattcagtgatcaagaccaagaaatacagggctcttccattaatcagtttttcaccatatttctcttttgagaatctacttggtccagaagctataacagatacaaacaaacgagaaatagtcttttctctctgaaactcgtcgtgtatttggagaaacaataagaaaagagacaaaatacaatgtaataagcaatcattttgtcatgcatggtattgattgtacttataaatagttacaagaacctaggaagactctagcccatactcctgaatccaaacccagcactcattctatggaaccacaaaccattgacagaaaaaacacaggcatcatgattcttagtcatgttgtcagaaaagatgaatgtgacatcaccttaaagttcctggatgattccgtagacctttctatcatcttggcagggtttgatcagatgatcagccaatgaatgactatctttttggcggcacttcccaggagttttttctaatcaaaatctcagactctcctagggacaaaacaggtttctacttgttgtctaagagccaataaggaatgttttaccaagcagttaatgggtttctttcatctctccatctcggctctgaattcccctccatagacaaagtctttgggtctctgtttcagaaattaccgtagggtagaaatctctgccaagccagaagacatttgcccactggaaagtaatgtaactggcttgaatttggtaaaagagtgaaggtttgagacaaaaacataccacttgggaaagtgataaaaatttatgaattgaattgtaaatcttgccattaagccaaccaaagagtaacaaaatctgaccaatctgacagcacatcagagttcttagcacagcaggctcaccatgtgtcatatacagccaggctaaagattgtattaaggacccccttaggtactctgaatttaaaataagtgtaataactcatttttaaacattttatatgatacttgaattattaaatattcacattacaaaatcagagaattttaatccattcaaaagggtgggttgtctaacactgaaagataatggtcatgtctagatagtaaaattacagtatatttttaacggatgtacatgttactttttgacaagacacaagtagtgaattttatcgtacaaattcctattgggtgattatgatacagagttttatttttgctaaagcaattactaatgtcatggctggatacctgtgcccattagtggctggttctgtgtttttttaggatggttattgatctcttgctgagctgagattcaggttttatgccagatagcttgattaatgggttggtttctataagtggactgaatggggatagaaagcaggggcagcctgctctgccaaccccaaatccgtcaagacgcatagctcattatgaaacagttatcaaggatacatgaaaaattaattgggctcagtttgattctgaaaagaatcggctttctacttggcgggcccccccgccccccttccactctttccagatgttctgcaccagcccctagagaaacagcaaagggagacgtattaatacattgtattgattagatcaagacccctgacagttatttgtagagataccatctggctgctgttcgaattccttcaccaaaaacaggacgtgacatgttattaatctcaactctctaagtatagacagttgccttttctgctaaaccgcattttaccattccgtaggagatggaggaagacctgaagggtgcagaaattaaggttattacacaaattgagccatatggtccaaatatttcagcaagaaaattgccaggcaataaaaattgctcctgccttcctaatggtgtaaattacagtttaaccatggctctaatgatgtccttctgccgcgcttaactactgttacatgaaggacattgttttaaaaatataaaaaacaagtaaatgccagcagcgtgttttacaatctgttagtgtgtcattaagaacactgtcagaattacataaacataatggcaggcaacccagcatacaaaggaactcgtatggaaatagaaagtgtcttgaaaactctcttcattatctctgaaatgtcaagagcactgtcccctctggaagttttctagggagaaaagacctgtccatctagtgctttattctaattctcatgtgtgtcccaacagcagtgttttctaaatcaagtgtcacaacccatagtgagactaagtacacatctggtaccacaaccctgtccatatacaaaaaatgaagcagacaaggtgaggagacagctaatgaattctaaacaaaatgatagacgttgaccttttgaagtatttttgtttttggggaaaacagttaagactccactatcttccttgatgatgacatcaacaattaaaagtataatttctatcctcagcaaactaacctggcaacagaaaaccaaataccacatgttctcacttgtaagtgggagctgaacaatgagaacacatggacacagggaggggaacaacccacactggggcctattaggggggtgaggggaggaagagcatcaggataagtagctaatgcatgtggggcttaatacctaggtgatgggttaataggtgcagcaaaccaccatggcacacgtttacctatgtaacaaacctgcacatcctgcacgtgtatcccggaactttaaattaaattttaaaagtataatttctgtcatccctatttggggcatgatattaagaggaagcttacttaagataatcaaaaatctttgggaattacaataaagaccattaatatttgagtaagacttgaacccttcaaatatttttagacctattacaccaaaaacacctcggcacttaaaaattccatataggtcatattgatgttttattctctaaaactgcacaatcctccaagctttttggtcttctaagatgttataaacacagtttgttaaaggaaaagtccagataaacgtttgtagaaaaatttgaagggaaaactacttttaattcccagaggagagttgccttatctttaagccctttttccttctccatttccccaaagggagaaagaccaggatataaattgccctttaaactaaaaaagaaaaaagagagggaaaaaacctaggaaaccaaaaaattattctttttgcatgcatgcattaatattaatgagaacccattaagttattatttcctcatggcacaaatggcaaggctagcaatctattgactagagcatcttctgcctggaaagctcttacccaggtgtccccatggttggctcccacactttcttctggtcttaagtgaaaagttactaccactaaagccttacctggcctactcagctacaatttcactccactctccctcacacacactttctattcctcttctgtctttatttttctctttaatatttagcttttatttctggtttcttgctaacctgtaatcatatttcagaaattgtttttcaaatgctttgttatgcttcttatttcacctaaaaggaaatctgtatgttcacagctaaatcaaactgagaaagcatcatttatatgttccaatttcaatttataagctgacaacttccacataaaacatattatgggcactttacacatgccatcttatttcacctcaataaccaatctgtggagtattattacctaaatttattaatgaggaaatggaaactcagagaggttaagtagcatacccaaggtcacacagctagctgcagagtttggatttgattgcagctctctcagcttctaaagccttttctttctgttatccagtattgcttcttgagtttcagcctagtggaacaagatgttatttatgaaaagctaaacatcaatgaaagccacaaattatagttcaataggacaaagagatgacacagagcttgatatgattcattgcctagtataaatatagaaaacaattgataaaagtttcaaagaattaaaagatcacttggactggaaaagttcagagaaggcttttgggagaggtctgtgctttgaacaatgggtgaaattcaaatagaagaaaagtagaacagatattaccttattcaggcaaagaaacagaagcctggttttgaaacatctgatggcaagtctctgcttcaggaggtcacatggggaatatttttccaatatgcccccattaattgggctgatattaaaacaactgatttaaaaaaaaaatcaaaatactcccaagagatgcctagcaaagctattgagtgaggtggttagcagcatgggtctggggtcaggaaacatagattagagactggctttggcttttttactcattgtatgccttcaggaggttatgcctaatagtgcctcccgcagagaggcagcacctcttagagtcgcaggaactgagacggcactcagtaaatagtggtgagtaagattcaaaataggttttcagagaagaaatcagcacatgaagatatcatggtgtcatagtgtgttgacagggtcctgtctggagatactagtccagaatttcaaaaaaaggaaaagttttcttctggccgggcgctgtggctcatgcctgtaatcccagcactttgggaagccgaggtgggcagatcacctgaggtcgggagtttgagatcagcctggccaacatggcaaaaccccatctctactaaaaatacacaaattagccgggcatggtggtgggcacctgtaatcccagcaacttgggaggctgaggcagggagaattgcttgaacccaggaggtggaggttgcagtgagccgagatctgccactgcactccagcctgggtgacagagcaagactccaaaaaaaaataaaagaaagaacaaaagaaaagaaagacaggaaggaaggaaggaaaatttattatattttcttgtttcccctgcattccctaatacccctttcccaaaagtatggatttcttcactaaatatgttagtagcagaatggtcttgtggcagttgacccaagactccaggtagagcagtggggaaagaaaagacaaggccagccaagaggccagccaagaggacaagctcctccaaaggttgacttgagatattaaactcattgaaaaagttactcaacatccacagtgttctggtggtacctcacttagtcctggacaatgaatcacagcccaagcttcatcattgaattggtgacactgccgagggccaactcaccagccttcaaaaacgacagtgctgctgacagcaaaggcgatgaggacacacatgtgcatccacccttgagatgctaaaagaggcaggaaagaacttgagggaaagaacaaatcactcttctgagattgtcctataaactttataccaggacctatgctatcatcctccttacctaatcatgtttaatatctgatttataagaatctaaatgtgtacctaaaagtagctttctaaatattactgggccacattaaactgtgaccaattttcttccttcctggcctaccacattttagaaatatgatagcatatttgggttgggagtcgctaaaggcctcaagagagtccatctctttgtcctttctgactaggaagacctggtcatcacgccacaagccttggtgtctcgtttttaacagagcaataattatttattagtggaatatatgcttattatatccagaaattaaagttgttaggggacatttgtgtatccaggtccctgtggctgggtgatcgcatctgttagaaataaatcactttaagaaaattatattagccccacagacagtcaagaatggagcaaagggagggaagtgtgaatagggtgaggaagcttgattttaaatcttgtgaaatagagtgtggtcaatatgttgtcagcacattacagtgtgcagacatcaactccatttttcccctctttgaacctcaggtggccaattaacagtatatgctatttattcattacaaaacaggcaggacaaattgaatggttagaatgactaataagaattcttagcaaggagtaaaataaaaaatgatacataaggagagaccccccagaaaaactttagggatttccagaaaaaaaagtcttgaggagttttcctgttaaatgtatctagaatttctactgacatgaggaaattaaaatggaaagattctctttgaatacattttcttcctaaaatatgttctcttcaattccctcatttgtatttccttagagtttcattccttcctaaagcagaaagacagttttaaattacttctagcaattataagtatcattagggtgttttgatgctgcatttttacaacaagcactgtgcttgccttccttatttgtctctcagttcaactccaagtcgcaacacaggaaatgaaaaccttgtaaattgacttgatcttatgaatactcacttttgcaaatatgaaagaacttaagaagggattataaaatactccttatctatataattaaaattcagttgaaatatatgaattcaatattttaattcatgcatttcattttgcgggcattcaaagattatatgcttctatatgtctgccattgatttctgtaaataacattatctctcttattgcaaaacgtacatcagaagaagttggaagaaagcgagggcttgagggatgttaaactgaagcagcagtgacttactatgcagtgttagtagattgcttgccttgaggatctagaagccgatagaagaaatggagccagcaaataagaaatttcttatttcttattccagaaataagaaattctgaacttttaccttcaaagatccaaaaagaacatgctaatgttcttttttttctaacttttgagtaatttagtcattctcgttcagaaaattaagggtctacatctggcagcaactgaaataaatggctcaattgagtacacacttgaatgtcaaatatatcactttaaaagtcaatatttgtttcagctgtaaatgtttctgaacggaaatgatgcttttagtgtctgtagtctaaggagtagttttatttttgaaccctcaaattgagtgctccacctagagccgtaggaccctttcctttccatgaggagagcgccctctactgggtatgtttacttaccacgcatgactgttaagaccctgagctaaacgtatgagcagttgagatgtacataagaaagagtttttggaaaatctttgcccctgcttgtactagaatgattgcaagtgtggaagtagccatagttcactgtagttttctttttactgctgtattattgcaccctgttgggggatacatctgagcatttcatgtgtcctacttttaaaatgcccagatggtggctacgtgctttggtttgaattgggcagccctcatctttcatgctctgtagtctgcctcgttatcagagagacatgagacaaggaaaattcttccatttttcagctcctcttcatctgtttctagtcacccacagtgaatgatgcacttgcacaattgttaaaatgacagtcactgtgataactgaacatcacttccctgggatggggagttccctatgtacccatagcttcttgattccttcccaatacagcacctttttcagtgtaactgatcacttgcaatcttgtaagtaacacagcagtgagaggcagtgtaaatattttataccttgccccaatcacttgtatgtgcatcggtcttcttcactctagcctttaagcttaacagagattttaaatcaaatcattcaaccctagaaatagtcaaaagaattaataaaataaatgaaacagtgtaactggttaaaatagccccagtgcacaatacaggtttagtatgattttgtgacatacacattttatagggcttttgtctccaactacattcttcaaagagccatctgggcaatgaccataggtatcatttttaccaataatagtcagcacttcccactgggaaattagtcaagggaatgagtttttttttttttttttttttttttacaaattatcttcaagcatctatcttccaaaaagtattactggactttgtccattacaaggcaacaacctaagtgagttacttgtgctcttattttagaactttattcatcagatcattgtgatcaaactcaatttcattttcaaagaggaaaaagattttgctctgtttttcttcttaataataggtttgctgaaggaagaacattaatacaggtcagcgatctccaaactttttagaatattcacttgtagaaataataatttggggagcacacatctgcataatatgtatatttacttatttgtaaattataaaatatgtactagttaaatagtatcatttacactatagaaatagacatttttaaaggagtggaaatagataaaattatcaagaaaatattttattatgagcaactactatcaataatacctcaaggcacaatacacactgaaagattaatcattaatgatgctgaatgtcaatctctttcctgagtgttcttgatcatttcaaaattttgttgacacttctgatcaaatacaattggaccattcatgtttatacctcatgctgtggttgataaggagcttgaaggaaggagaatcagactggccatttatttgttcttcatttatgtttgtattgttagtgttatatttgaatcataaatttgaattctaggaattttgaaagccattcatgtttccaaagttagtatacttaaaaccagataatataatccataaacccccttagcatagaaccataaactacaatatgtcacttgacacaaggggtccagaaccccggggacgcagaccagtactggtctgtggcctgttgggaaccaagccacacagcaggaggtaagtggagggtgagcctcaccacctgagctccacctcttgctgtgctccacctgaggagtggagcacagatctgctccacagatcagctgtggcaattgcttctcacatagcaaaccctattatgaactgcgcacgcaagggatctaagttgtgtgctccttatgagaatctaactaatacctgatgatctgaggtggaacagtttcatcctaaaaccatccccacctcccccttccatggaaaaattgtcttccatgaaacggatccctggtgcccaaaaggttggggatcactgctttgcactaaaagcaaacaaatagatgaatattgttagctcctcgctgtaaaactcccattcttccttttccaaggacagatacagaacttaattgattcattcattcactcatccagtcagtatgtgtatgcatctaatatatgccaactgggtatatgacagtgaataaaccagacaaaaatgcttccctcttgaagctcttactctagtggggagataaagacaataaacaagataaggaaataaaatatatacataccatacataagctaagggcaatggaggaaaataaagcagattccagagtctccattataaaaaatacaacttttgcaaattggtctttagttcttattgagtttaaaaggatgtttcccttccacatccttcttcccactgtcttctgggatttttgcttcagatatgatggtcaaattgcttattataaattcccttctaagattctatgagttttaaatttgttttaattgttcacatgttgcattgaatgatgcaattgtactcttctagcacacagagctagtaaatttcctatatattgatatttaaagcctgtccttttatggagtattttgtgaccacctaaacccatgatgatttcttgtgtatacaccttcagtgcttggttcccatgtatttctctagtggtttcagaaaggtgagttttacattcctaatggattacagttcctaaaatccagtatgttcatactttctacttttattcctttccatttagtgcctagaaccatgccagaaaaagacataatttgactgtggatttaaccctcagatcacaaaccaatctcagagctttatttttttgctgagagttttaaataaactataaagtcaaatttaaacaattatcctttggaatcaacagaaccccacatttccttagctttccttagctgttcctattcccaaggatcacattcagagcactcttcttgagtgacagtgatgtgccaggtacttcacagaggtcatctgttttaattgtcacaaaagcccaagagaaagatactaactgttagaaatctagctcagaaaaagtagatgatttacctaaggtacatctagtgtgagtgacaatcagaacttaaactcaattcttctaagttgactgctgttttgattaaagcgcctgggctctcagaagtggactcttcctgggtgttagtcacaagggcttctcagaatttttctcctacatatgagacagcagatcatttctgcctctctgctaagataagccaagcaaaataatagattgtagaacaattaataatgcattcaaaatgccaaactcagcacactttctatcctttgtgaaaaattttgttcccattttgtccaaatgtctaataaaaatgattgtggaaaaataaaaacaatctttgatctgcctaaatgaaaataagaaccacaacttctagctctcagaacaaatcaaagttgtttttatttttaattaagtatgctaagcttaagtacattttctcttaaggtgtaattactaaaccatgatgatttctttttgtttattcatttaaaacacaaataaaagcagataatcaatagatcataatctaaaactagaggatttacaagttaataagcttgagtcaatagatattccataacaaagctttcaatgctgaacctgacataatttgctttgcactaagctggttgacttaatgctttaatttaattccaatattaactgaaaaatccaaagaaaaggggaaaatttaaatcctattatactgaaatatgttcaaagcaacaactcaatatcctgccacaactgcttaagtgtgccaccaaatgtctgcttaatcacctggtttctgattggtgataaccagttaacccgtttggagcctggtacaagtgaattgtggaagtttctcagtggtccattcatgcaatagcttttatcttagcctcaacagtcatcatattttcatctcataatgtctacttttcctgacttatggccaaattattggagttgtttttatttgaaaagcaatttctccttgtctcttgagattaccatccagcctgacctcccaaaaagcagaacagtaggcaggcctaggtcaaagaacagaagaaagcctttcttagttccctgaaaggaagatgtaagaagctatctgtatgaagaaatagcattagatggcatccatcatgcaaagtctggtagtactagtagaggtagtgagagggatgtgaggcaatatccagcataccttcaaggttatgagcacagactcaaaagacaggatccccccaggcaaatcctggttcttccccttacaattatatgaccatggacaatgtgcttcgactctcttttcatccatttccttatctgaaaaatgagggtcataatagtgtctatctcataaggttgttttaaggcttacacaatttaatatacataaagtacttgaaaagcactcattgttatcatcctttgagatactcttgaggcataaggaacttatgctaagaataattttgagaacagcagcatcagtcactgaatatagtagtcagatgtgtctttcagaagagttatgtgtgcacggccaaagtcctaaatattccatttgttaccatccttaaaatatcatttgtgaatttgtaactggtttttgctttgtgtcattgctggtcgactgcagtcagggtggcagtgttttggctgccccctaccatctttagttttctggtcccattagtgttgtgaccaagaacaagttagtgccctttgctcaagtaaatgggctagaagttaagcactgaccttttaccataggggacccttttctattctgaaagagaacttagaaaacagaacagaaatctcattgatttttacaatgcacattttttcatatttctccgtctctgaaattgcatgcatctaacaatcttataatcactgtagatggcagttgttacatacttgtcatttcctgtgcctgcacaaactctcgtcacttcacttgagttctgtgcaccgttggtacgacacacacattgagtttaattgccacttaaaatggcttcaaaaaatcatactatgatttggcattaaaataaaaagtatacacaaaaggcacagaaacagtcacttcatataaaacttaaaaagaaaaaacaaactatgcccatgcaagtctaaagaagtctttcaataagtataaaatacacatctaagtgataaaggaatcactgtgttcttgttgaattagcagcatatttttctctttcttagggatacataaaatagtttttaaaaaaataacagtgtgtttaaatagatgaaatcctggaccccaaaaataggtgtgttttataataaatatttttaaaacagctagcatattgccaataagataatgtatttaaataaaagataatttattcattccgcagacatctatagagcacccatatggtgccaaacatattttgtatccctagtccctgtcctctaagagttcaaggtctagtggggagaaaaggcaggtaaatagatcaatctaatataaaaatgccataaacagcagaaagaacagagaagagagacaagtaactcagtctggggagtcaagacactcttccaaatggagatgacattaaatttgtattttcaaggatggaaatacatcctttccaggcatagaagggcattctaagaaaagaggaaatcatgaacaaaagcgcagcctcattgaagagtgtgttgtaactgggtctgagtcatgagtctagggacagggtgtgaatgaaagaggcagaccagggagaggctaaggatgtgcccaaagagacaggctgcaggagattttgctggtaagggctggcaatcaaaaccaccctgcttcctaaccaggtctaggctctggcatcactctgacttttaaattaggaaagttagagcttgattcttgcacttgactctgtcaatgcattaggatctaggagagatggtaagtgatgttggaaagcagtccaaagttcataagcagttagctatttccatccaaggatgccatgatttcctctcctgaaactaagtgaacagccatgggtaaaaatgaactgaaggcagaacatgggcctctcatgtaaaagcagaagtaggggattcccaggcaagatggccaaatagaaacagctccagtctgcagctcccagtgagaccaacacagaaggtgggtgatttctgcatttccaactgagatacccggttcatcccactgggactggttggacagtgggtgcagcccatggaaggcgcagaagcagggtggggcgtcgcctcacccgggaagtgcaaggggtcggggaactccctcccctagccaaaggaagccttgagggactgtgccatgaacgactgtgctatctggcccagatactacacttttcctacagtcgtcacaacccacagaccaggagattccctcaggtgcctacaccaccagggccctgggtttcaagcacaaaaccaggcagctgtttgggcagacactgaggtagctgcaggagtttttttttccataccccagtggcacctggaaccccagcaagacagaactgtccactcccctgaaaagggggctgaagccagggagccgtgtggtcttgctcagtggatcccacccccatggagcccagcaagctaagacctactggcttgacattcttgctgccagtacagcagtctgaagtcaacctaggatgcttgaccttggttcggggagggatgtccaccattatggaggcttgagtaggtggttttcccctcacagtgtgaacaaagccaccaggaagtttggactgggcagatcccaccacagcaccgcaaagccgctgtagccagactgcctctctagatttctcctctctaggcagggcatctctgaaagaaaggcagcagccccagtcaggaacttagagaaaaactcccatctccctgggacagagcacctgagggaagggctggctgtgggtgcaacttcagcagacttaaacgttcctgcctgctggctctgaagagagcagcagatttcctagcacagcacttgagctccgctaagggacagactgcctcctcaagtgcgtccctgacccctgtgtcttctgaaagggagacccatcccagaaggagttcatagacatctcatacaggagagctccagctggcatccggcaggtgcccctctgggacaaagcttccagaggaaggagcaggcagcagtctttgatgttctgcagcctccactggtgatacccaggcaaacagggtctggagtggacctccagcaaactccagcagacctgcagaaaagcgccctgactgttaaaaggaaaactaacaaacagaaagcaatagcatcaacatcaacacaaaggaagacaatgaaacaaccccatccgaaggtcaccaatatcaaagataaaggtagataaatccatgaagatgagagtaaaccagcgcaaaaaggctgaaaattccaaaaactggaatgccttatctccaaaggatcacaactcctcgccagcaagggaacaaaactggacggagaatgacttcgacaaactgacagaaataggcttcagaagcaaggtaataacaaactcctccgagcaaaaggagcatgttctaacccaatgcaaggaagctaagaaccttgaaaaaaaaggttacaggaactgctaactagaataaccagtttagagaagaacataaatgatggagcagaaaaacacagcactagaactttgtgaagcatacacaagtatcaatagccaaatcaatcaagcagaagaaaggatatcagagattgaagatcaacttaatggaccagtgcaagaagattagagaaaaaagaatgaaaaggaacaaacaaaggctccaagaaatatggggctatgtgaaaagatcaaacctacatttaattggtgtacctgaaaatggcaaggagaatggaaccaagttggaaaacacacttcaggatattatcaaggagaacttccccaatctagcaagacaggccaacattcaaagtcaggaaatacagagaacactacaaagatactcctcaagaagagcaaccccaagacacgtaatcatcagattcaccaaagttgaaatgatgaaaaaaatgttaagggcagccagagacaaaggtcgggttacctacaaagggaagcccatcagactaacagtggatctgtctgcagaaaacctacaaaccagaagagagtgggggccaatattcaacattcttaacgcaaagaattttcaacccagaatttcatatccagccaaactaagcttcaaaagtgaaggagaaatgaaatattttacagataagcaaatgctgagagattttgtcacaccaccaggcctgcattacaagagcttctgaaggaagcactgagtatggaaaggaaaaacttctaccagccactgcagaaacataccaaaatgtaaagacgatcaacactatcaagaaactgtatcaactagtgggtaaaataaccagctagcatcataatgacagaatcaaattcacacataacaatattaaccttaaatgtaaatgggctaaatgccccaataaaagacacagactggcaaattggataaagagacaagacccatcagtgtgctgtattcaggagaccaacctcacgtgcaaagacacacataggctcaaaacgaagggatggaggaatatttaccaagcaaatggaaagcaaaaaaagcaggggttgcaatcctagtctttgataaaacagactttaaaccaacaaagatcaaaaaagacatagaagggaattacatagtggtaaagggatcaatggaacaagaagagctaactatcctaaatctatatgcacccaatacaggagcacccagattcataaagcaagttcttagagacctgcaaagagacttaaactcccacagaataatagtgagagactttaacaccccactgtcaatattagacagatcaacgagacagaaaattaacatggatattcaggacttgaactcagctctagcagatctaatagacatctaacagacctaatagacatctacagaattctccaccccaaatcaacagaatatactttcttctcagcaccacatcacacttattctaaaactgaccacataattggaagtaaaacactcctcagcaaatgcaaaagaatggaaatcataacagtctctcagaacacagtgcaatcaaattagaactcaggcttaagaaactcactcaaaaccacacaactacatggaaattgaacaacctgctcctgaatgactactgggtgtagaatgaaattaaagcaaaaatacatacgttcattgaaaccaatgagaacaaagatacaacataccagaatctctgggacacagctaaagcagtgtttagagggaaatttatagcaataagtgcccacaagagaaagcaggaaagatctaaaatcaacaccctaacatcacaattaaaagaactagagaagcaagagcaaacaagttcaaaagctaccagaagacaagaaataattaagacgagagcagaactgaagaagatagagacatgaaaaacccttcaaaaaatcgataaatccaggagctggatttttgaaaagattaacaaaataaatagactgctagctagactaataaagaagaaaagagagaagaatcaaatagacacagtgaataatgacaaagggaatatcgctactgatcccacagaaatacaaactaccatcagaggatactataaacacctttacataaataaactagaaaatctagaagaaatggataaattcctggacacatacaccctcccaagactaaaccaggaagaagttgaatctctgaatagaccaataacaagttctgaaattgaggcagtaattaatagactaccaaccaaaaaaagcccaggaccagaaggattcacagccgaattctaccagaggtacaaagaggagctggtacaatttcttctaaaactgttccaaacaatagaaaaagaagaactcctccctaactcattttataaggccagcatcatcctgataccaaaacctggcagagacacgacaaaaaaagaaaatttcacaccaatatccatgatgaacattgatacagatattctcaataaaatactggcaaatcaaatccagcaacacattataaagcttatccaccacgatcgggtcagcttcatccctgggatgcaaggctggttcaatatacctaagtcaataaacataatctatcacaaaaacagaaacaatgacaaaaaccacatgattatctcaatagatgcagaaaaggccttcaataaaattcagcaccccttcatgctaaaaccactcaataaattaggcattgatggaatgtatctcaaaataataagagctatttatgacaaacccacagccaatatcatactgaatgggcaaaagctggaagcattcccttggaaaaccagcacaggacaaggatgccctctctcaccatttctattcaacatggcattgaaacttctggccagggcaatcaggcaagataaagaaataaagcatattcaaataggaagagaggaagtcaaattatctctgtttgcagatgacatgattgtacatttagaaaaccccatcatcttagcccaaaaatgccttaagctgataagcaaattctcaggatacaaaatcaatgtgcaaaaatcacaagcattcctatacaccaataatagaaagagagccaaatcatgagtgaacttccattcacaattgctacaaagaaaacaaaatacctaggaatacaacttacaagggttgtgaaggacctccccaaggagaactacaaaccactgcacaaggaagttaagagaggacacaaacaaatggaaaaatattccatgctcatggataggaagaatcaatatcctgaaaatggccatactgcccaaagtaatttatagattcaatgctaccccatcaagctaccattgactttcttcatgaaattagtaaaaattactttaaatttcatatggaaccaaaaaagagcccatataaccaagacaatcttaagcaaaaagaacaaagctggaggcatcatgctacctaacttcaaactatactacaaggctacagtaaccaaaacagcatagcactggtaccaaaacagatatatagaccaatgaaacagaacagaggcctcagaagtaacaacatacatctacaaccatctgatctttgacaaacctgacaaaaacaagcaatggggaaaggattccctatttaataaacagtgttgggaaaactggctacctatatgcagaaaactgaaactggacccctttcttagaccttatacaaaaattaagatggattaaagatttaaacataagacctaaaaccataaaaaccctagaagaaaacctaggcaataccattcaggacataggcatgggcaaagaccttatgactaaaacaccaaaagcaatggcaacaaaagctaatattgacaaatgggatctgattaaactaaagagcttctgcacagcaaaagaaactatcatcagagtgaaaaggcaatctacagaatgggagaaaatttttgcaacctatccatctgacaaagggctaatatccagaatctacaaggaacttaaacaaatttacaagaaaaaaacaaataacctcatcaaaaagtgggcaaaggatatgaacagacacttttcaaaagaagacatttatgcagccaacaaacatatgaaaaaagcctcatatcactggtaattagagaaatgcaaatcaaaaccacaatgagataccatctcacaccacttggaatggtgataattaaaaagtcaagaaacaacagatgctggagaggatgtgaagaaattggaacacttttacactgttggtgggagtgtaaattagtttaaccattgtggaagacagtgtggtgattcctcaaggatctagacccagaaataccatttgacccagcaatcccattactgggtatatacccaaggcattataaatcattctagtataaagacacatgcacatatttattgtggcactattcacaatatccaagacttggaaccaacccaaatgcccatcaatgatagactggataaagaaaatatggtacatatacaccatggaatactatgcagccataaaaaagaatgagttcatgtcctctgcagggacatggatgaagctggaaaccatcattctcagcaaactaacacagaaacagaaaaccaaacaccacatgttctcactcataagtgggagttgaacaatgagaacatatgggcacagggaggggaacatcacacactggggcctgtcaggggctggggagaaagaggaggggtaacattaggagaaatacctaatgtagatgacgggctgatgggtgcagcaaaccagcatggcacatgtatacctatgtaacaaacctgcatgttctgcacatgtatcccagaacttaaagtgtaattaaaaaataaataaataaaagcctgggtgtggtggatcatgcctgtaatcccagcactttgggagtccgaagtgggcagatcacctgaggttgggagttcaagaccagcctgaccaacatggagaaacgccatctctactaaaaatacaaaattagctgggtgtaatggcacatgcctgtaatcccagatactcgggaggctgaggcaggagaattgcttgaacccgggaggcggagattgcagtgagccgagatcgtgccattgcactccagccaggtcaacaagaacgaaactccatctcaacaaaaaaaatataaataaaaaattttttaaaagcagaagtaggattacagaaagcagagaagcccaaaagatttgaatgttcactgacaaacacagcaataaagtatttgatattgcaggcttcatttgaagtaaagcttcaggaatacctggaaaccaagctacaggtggcactcagctccctaaccagcctttgccaagaggaggggtctttccagagacaaccatagagagtaatctttagccatgttatcgtctaatatcaaaaatagggggcaggccaggtgaggtgactcacacctgtaatcctaacactgtgggaggccgaggcaggcagatctcttgagcttaggagttcaagaccagcctgggcaacatggtaaaactacatctctacaaaaaatacaaaaaaaaaaattagctgggcctggtggcacatgcctgtagtcccagctacttgtgggactgaggtgggagaattgcttgagcccaggaggtcaaggctgcagtgaacagagatcatgccactgcaccccagcctgagtgtcaaagtaagaccctgtctcaaaaaacaaacaaacaaaaaaaaaagagggtgtaatggaagtgttttaatatgaccacggcatcctctcactgagatctgctaccatttattttattttgtttgtttagagacaggtctcactatgtcacccaggctggagtgcagtggctccatcatagctcactgtatccttgacctgggctcaagtgatcctcccaccttggcctcccaaaatgctggttagaggcgtgagccaccatgcccccatttgtaatttaagctgataaatgagagcaggggcacaagtctgtatccgctaactcttcagcaacagctgacccaaggccagcaaacccattgcatagccaacaaccaaccagatcctgtctttctgaagacacacagagacagtagtcagatggttatgactaataaggctgtaaggttgtttagactgacaattggtagccatgctgggcaaaagggaaagaaagaaaattaagagaaagggaaaagagagagaagtgccatgcagcccctgagtgacagagagagaaactcagttctgacagttttccagtttcaaaacccaaacctgtaaagttgacccttgaacaacacaggtttgaacaggtccacttacccatagcttttcttctgcctctgccactcctaagacagcaagagcaattcctcctcttccttctcctccttgacctattcaacaagaaaatggcaaggatgaagacctttatgacctttctcttccttatgattttcttaataactttttctctagcttgctttattgtaagaatgcagtatataatacatataacaaacaaaatatgtgtttgttgacagcttatgttgttggtaaggcttctgttattagtatcctgttagtagttaagttccgggggagtcaaaagctatgtgtaggccaggcacagtgggtcatgcctgtaatcccagcactttgggaggatgagacaggcggatcacctgtggtcagaagttcaagaccagcctggccaacatggggaaaccctgtctctaaaaaaaaaatacaaaaatttgggtgtggtggcacacacctgtaattccagctactaggaggctgaggcaggagaatcccttgaacccaggaggcagaggttgcagtggccaagatcgttccactgtactccagcctgggcaatagagagactctgtctcaaaaaacaaacaaacaaacaaacaaacaaaaacagaaagttatgtgatatgtagacgtttgcctgtgtaggacattggatcccctaacccttgcattgctcagaggtcagctgtagcttctgtacaggcttgggttctatacttgccttttctcttccttacaaaaccaatcaaaatgagtttcttttccctgtaactaaatttccttgactagaatattgattactgccaattcccacctttcctgtaagttgtaagttttagaatctggttgtttttttttattgggaaatacaattgatttttgtatgatcctaaaattgctgaactctataattgtttatttttagattctgtggaccttttaggtagttaataatcatatctcatgcttcaaaacccatgtaccttgtgttagaataagataggataggataggctctggtaacaaataaaattccaaatctcactacctaatgcaataaaagtgggaaagtcaaaggtggatttggctgcccttctccatcttatatcagtgtcagatcatgataggggaagagcatgctgcagagttctgcaagaagcttttaaggtccagacctggaaatagctgacattccttcttctcacatcccattgataagaatgtctcataacctctctatttaggggcagggaaactagcaactgcgaaaaaagtaaaataaatgaatatttggtaaattataataatctctgctgcatagctctttttatttccttatcttacattgcctaggattaccactacaataataaatagaatgcatctgtcttatttgttatattaacaggaagactgctaaagttttatcattaagtatgattttgctatatgagtgctgaatttttctcttgagatgattaaatgtaaaacaacttttctaagggctaaatcctatatggtcattgctctggactgaatgcagttgcccactccctttccaaatccttacaatgaaatcctaaccctcaatgtgatgttattaggaagtggtaaggggacaaacaagtgaagagacagatacactagagtataagatctatcaagtaataaaggtggacctgtgagtaaattcaaaccatttttctctcttgagtagccatgcttatgacaaagaaattttgaatgccttgtgggttgtttgtttgtttgttttgagatggagtctctctctgtcacccaggctggagtgcagtggcgtgatctcggctaaccgtaagctccgcctcccgggttcacgccattctcctgcctcagcctcccgagtagctgggactacaggtgcccgcaaccacgcccgtctaatttttggtatttttagtagaaacggggtttcacagtgttagccgggatggtcttgatctcctgacctcctgatctacccgccttggcctcccaaagtgctgggattacaggtgtgagccaccacgcctggcaagaaattttgaatgtcttgttttcaacaaatagttttaatttaaatcgaaaagagtgtgtaggtatgagttgcgaatttgtaattcatttgcgattctggtattgatggattgtcttatcttgtacaggtcatttgggccctatggactttaggctcaacaacaaaatcagacagttggagtacagtgccagtcacaatttttagactgtttaaccctaaatgtctttctaataggccttatttatatgagaacattttatagttaaccacaaatattttgtctgtgtttatcaagagttacaagcatagcagccctttctttactgaataaaagttcaaacaaattggattcatctttatttggagctgccaattaaagtgggatatagtatagttaagcagtactcaacatgtaggccactaatctcttagggtcccaaacactctttcaggggctctgccagggaaaaactatgttcatactaacagtaagaacttacatgtctttttcaccttcatccccttcatgagggtacactacagtggagttttccagaggctccatgatgtatgaggatgtagtcactctgctggctagtcgtatacatgtctcagtattcttttcctttaaacacttctctactttaattttcaatatggtactattgatcgatataaagatcagaaacaaaagttctttgggatcttcagttgtttttaagaaacaggggtcttgaaatgaaaacactggaactactaatacacttcacaagtacattttacctccacatagcacagaaataaaatcataaccctgtctcttgtcagcagtatgactctaggtaagacatttaacttatctaagcctcaatttccttatgtataacaatacaaatctcctagcttcatgtgaagatgaaatgggatacaccaagtctgacatagtaggagcaaaaactttgctcacaaataatctaccttaggaaggatagacaagaaaatggtaaactggttgggtgcagtggctcatacctgtaatcccaacaatttgggaggccaaggcaggtggattgcttcagcccaggagttcaagaccagcctgggcaacttagtgagaccttgtatccacaaaaaaaaatacatatgtgtgtgtgtgtatatatatatatatatacacatacacacacacacacacacatatatatatatatatacacacacaaaaattagctgggcatggtggcacacacctgtggtgactcaggaggctgaggtgggaggattgtttgagtcttggagacagaggttgccatgagccaagatcatgccacaatactccaacccgggcaacagagtgagactctgtctcaaaaaaaaattaaaaacgaaaagaaaatggtaaataaataacttttgttaccataagggaggagaactaaacaactggggcatgggggaggagatggggaacttttcattgttgctgcacccttcacttagaaggtccagtttatgaaaagtaataatttagttaaaaccttcaaaaatgatttttaaagaatttccctgctcctcatagatatagcctggtagtttacataccacttcattttctatgaagtactgttgttgcaaatttatctatgcaaagagctaagcatgcaatgattgttgctgtgggtataaaatactgctttgctaaggatactgtagctaactcacagttaattggctgaggcctgagcacacccatatcagtttgccatatacagatttttggttaacttgatttccatatgcaaagtgagaagaaagttctaattcatatatatatatatatgtaaaatatctttctctcctgagtcatcaatctctacctcattattgaaaaattgccatcaatataaaaatatactcctggtatctcccattttttaaatatgtgactccacgggcccctccagctaccatctcctgttcctgttcccctttacagtttacagccaaacttctcaaaagaatatattactattccctgtttctacctctacacatctgttctcccttccacccactccaaccaggtttctgtccttatcactccattaaaaggctcatatcaagacgatttgccacgaaatcaagagctcttcctatgcacagcttccttaacatttcagcagcatttgacactgcttaccacacttctttaaaaaataccctcttctctcagtttcaaggagaacacactgtattggttttcttccctttattgtcctggtctcagcttctattactgatttcctttcggctgctgtccaagtcagcctcatcctgcatctgccactgagtttggtcctgagctctctcttctacttgacctacactctctccttagactattcctagactcattcaagtctacttcttagacttcactctacattcgcttcttcaccccagcccttcagcttaaattctgtccatattcactgataatacaaatacttttgaacacttactctagcccagccacaattagaggcatttggggtttagagagaatgaagtagatgcaggcctttgactctgtggagtttacattctggcaaggaaagacagacaacaagcaataatcataaaaaaatatggtatgttagaaggtgatgagtgcttaagaaaataaatcaggataaaaagaatcaaaattgggaggagacagggaggagagtgggtcagttgcagttttaaagaagagtggctcattgagaagatgagctgaagttactcatgcaaacctatgcataaagtgggttgcaggcagagaaaacagccagtacagaggcctcaaggcacgagcttgtttagtatgttttaaaattttcaacaagactagtgtggctgcagtgcagttttcccaggggaaaatgataggagacaatgtcagaaaggaagtggaagggtgggcagaaagaacaggctttgattatgaataacttgaggaactagaacagggttttgagcagaggagtgacatgatctgacttgtgtccaaaatacacttttgctatgtggacaatgaggatttaaggttaaaaataggctaactggctgggcacggtggctcacacctgtaatcccagcactttgggaggccgaggagggcacatcacaaggtcaggagttcgagaccagcctggccaatatgatgaaaccccatctctattaaaaatacataaattagcctggcctgttggtgcttgcctgtagtcccagctactcaggaggatgaggcagaagaatcgcttgaacctgggaggtggaggttgcagtgagccaagaggctgcactccagcctcagtgacagagcgagattccatctaaaaaaagagaaaaaaaggcaaactgaggctactgcagtgctgagagtgggaaagtatggcttggatcagagtggtagtagtagatgtggtgtgaactggtaggattctggatgtatcttgaagttaaataaatccagtcctatttcctaatgagtagagtagatgtgaaaaaaaagagaaaatgaatccaaagtttttggcctaaacaactggaagaatgaagtcgtcatcaactgaaaaaaagggaagactgcaggtgaagcagcttttctaggtacatcagaatcatttcagtcagggagactgaacactatgggttttgagatagaaagtttattattattgttcattagagacagggtcttcttatgttgcccaggctacactcaagcttctgggctcaagcaattcttccaccttagccttccaaatagctgggactgcaggtttgcatcaccacacccagctaaagatgagcgctttctctaggaattagaccttacgcaattgtgggaatagctgggaaagtgaagatttggggaggagagtaagaagatgggtaagggagttgccaccatgcccattcaagaagccaaggatggccagccaccttagtgtccctaccacagatgcctatggagaggtctatggaaagcaactcctctgtttagctaccatctctgtggggccagcactaagtgtcaggtggtagacctgggccactattggttaaagagtcagcagctggaaagaagagtcagattggagtagaggagaatgaggacaatctggaacccacttgcacctctgtgtctattcatcttcacatctaacttcaaccaacttcgaagagtaatggccactgatttactttcattctccaaattgtatgtaaatgtatctttaatccagaactagatagagaagatatattactgctatatataacaaagtacaacaaacttagtagcttaaaaacaatttctacttgttatctcacagttcccctttgtcaagagtctcaggccttttgttcgaggtctcataaggctacaattagggtgtctgttgggctgtgttctcatccggaggtttgaatggagaaacatttacttccaatctcattcaagttgttagcagagttcatttctcttgtgtgggaatgagagggaggccctggcttcctgttggctgttggccctcatgtcctagagaccacctagttcccctccacaggggtccttcacaggccctctcatagcatggcagtttacttcttaaagaccagctgaaggatttcactttcagtctgctgagatggtgtctgccatatttatggcagtgacatcctagagttttgccattttctattagttagcaacaaggcataggccctgactgcactcagggggagggagaatcacacaagggcatgattcattgcaggggtcaccttaaggtgtgtctcccacagaaggaattctgagatatgcagtttcaccttaaccaatctgacataatacaaacttcaaaaaagggaaaatcaagagatcatatggagacttgttaagtttcagatgtattagacatccaaatgaagaggttaacaagacaattggatacaagactggattttgggagatatgtccaaggaccctcaaatgtgtattcctaattcagtctcttcccaaaactatagtttcattggtctgtctacttgacatcttgaacttaacaagaccaaagttgttccttcccttcccaaatctgttactgctcagacttctacatctcattaaatggtaccctcacctaccctttctctcaagaagaaaaacctaagagtcgtccttcattcctctctttcccttgccttctacattcaatccatcataattctattggttctacattcaaaatataaatctatccccttaattctatgtctaccattaccaccctagtccaagccactattaccccttcctggccttcagcaaaagcctttgaatgtctcccctccctctcttgacccatgttatgaaatggattgtgttcctcccaaaatgcatacactggagccctaacccccaaggtgactgtatttggagatagggcctctaggaaggtaattaagcttaagtaaggtcataaagatgggaccttcatcctataggattaatgttcttataagaagaagagacaccagagatatctctctgcatgcacacaaagatgacacggaaacacatccagaagacagctgtctataagccagaagagaggcttcaccagaagccaaccatgaagacaccttgatcttagacttctaacctcaagaattgcaagaaaatgaacttctgtgtttaaagcaactcagtccatggttctttgctatagcagcccgagtagacaaatgcaatggcctccatatattgttcacacatcagccagaatgagttcttcaaaacctagattaaattgtgtcacacccttgtttacaggccttcgatagttttccactgaaattggaatcagacttgaactctttaccttggcctccaggattgataccatctagctcctgctcatccttttgaccttctcttgggccattcttctctccatcacccagcttggtcgcactagctcctttctgtcaacaaaaacaccaagtctgttcccatcttagagtttctgttctgctcttgctcccaaaactttgtcccctgattcttcacacagatggtgtttttctgcactcttgcctaaatgtaacttcttcaaggacctttcttacccgcccttgtaatcaagaatttcattcactcttccccaatacctaagcccaaacactaattagtgcaccaccctacttattcccttcataatttaccacaatttccaattctctctctatgtcttgatctctctatctccctctgtttatatattgcccatttgtcctcctttataatgtaaaattcgggaaggtaatgaccttgcctcccttgctttctattgtatcctcagagattaggagcatgcctagtgtataagaagctctcaatacatgtgtgtttaatcaaggcttaaataaatctaaagctatggcccaaatgaaaatttttatatgagttttagtacagttttgccactatttccatagaatagattatcagagtgaaattgctgggtcacagtgtatgcacatttttaattttgatagatcagaagtactgctttttaatatttagtgtgactgatttgccactttaaaatttaattatcacaaatttaatttttttcctcttctcctttgaaaaatgaggcatttcaaaaccatttttcccccaatgtttttatggtaactgaagcatcattgttcattttgcaataactctagcttttgctttataggttaaattgatacagccaatttgtctataaagaaaatgtctgtgaattgagtcttctttttgaattgacccctccattacaaaatgaatgatgtattctaaagagaggaaaaaaaaaaccttctcccttttcacgtatcattcttcttttctgagtgtagagagttgttggagtaaaagcattaaagtgatcccagtgttaatatgtggatcctccaagctgaacattttaagtttgaaatttacaattgttataacaattgtcccctgcctaatccattaggtgacagcattagctagaacccagagctaggaatgctttaacacttatgagtacatttgagttggcctcattgttacccagtcgtcaatagtgtccttaacatttccagctgcctcatcactgtttgatatgtacaaggggctgggacaagggtgtagagggttccactcaaacatgtccccagtatcaggagaaaacacacttcaggaaggcatggttctgatagtgggtcaggaaagaaaataggaaaattggttttaacaccattcagttattatacttcctgcctcaattgaaatcaaaagaaaaatccttgtgtctaaagaataattacaaattttgaaatagagtgaacgttccataaagaaaattttaaatcttttttctaagaaaatacttttcctattaccttgtgcaaatggcaatctatacttattggctgaataataattgagttaattaattaattcctggcagatttattatttcattagtcactgaccatgatctataccacgatagggtgaaatttaaaagttcttccattattccttcaaattgcattgcagagctcttcacacataattaggtcttaaattttttgcctaatgttacttattgtttcctaacaaatgcagttcaaaaactttagagtgacattcacagccctctttagtcttatcacaatcccctttccagccacaatccctactattcccctgcaaccatcacacttctgctttgttgaactgccacccaggtatctccagaactttctactgttccttcttctaatccttcatctatttttatctgctcaaattctacatctttcctgacctggatcaaatgccacgtctcaattaagtcttccccaagtcctcaccccctttcttctgaataacaagtatttccttagtatttctctggtgcttattatagcactgccacactgaattgtgtgtatgtatatacattattgatttgctctattagattataagttcctcagagtcaagagtctgtgttacccatcttgtatcttccattgcaattttatagagtcttttgcataaaagatgctcaaaaatgtttaaagaagtaaaccagctgctgagaaactgctaaatgtttgcactgagcattttggcagctgtgtcatcccacttggtgatgctgcctagcacatacacactaaaacaataggcctgaacactaaacaataggccatggtcctaaagggtattttgttctacctttcttgtattgtgagttgatctttgattccggagcaactctgcatgtacgtgtttgctgtcaaaataaatgtcttttttgtctcaccagctgagatacatttaggtgaagatggcactggtaaaggaagtgtgcaggtgaagttggtgaaaatgttctgacaatgtttatattttgcaggcttggaagtctcatgccaagtgaaccatggataagtattcaagtttgatatttgcctaatgcgtggtaaaaaaataataataataatttctgtatcaagactgatttgatggccaggctctgtggctcatgcctgtaatcccagcactttgggaggccatggcgggtggatcacctgaagtccgaagttcaagaccaacctggctaagatggtgaaaccccgtctctacttaaaatacaaaaattacctgggcgtggtggcgggtgcctgtaatcccagctactcgggagactgaggcatgagaatcgctcgaacccaggaggcggaagttgcagtgagctgagattgcgccattgtactccttgcatttcagcctgggcgacgagagtgaaactccatctcaaaaaaaaaaacaacaacaacaaaaaaaaaaaactgatttgaattttgcaaaatagtattagacataaatatgttgatcaacttttggggaacttaaaggttaactttataaatggagaggaaaaatcgtcctgcagaatccacgcctcaaattatctggctttcaaaaatctagaaaaatattttgtgttgatttgtctacattacgacatataaaagtcatccaattgcctggatgtactctatccaaagtcatggcttttagataacagttaatgggagctcgaactgcttctcacattttatttgtaatctaaatcagaaactctaggtctcaggtataatcattccttatcattaagacaaaataaaatataattaatgataaaggatctcggcagttcaacttaagaatacagaggttaatatacttaaatctagattcttctgaagttctctttgcacaaaaaggtgaatttttgatgtgacttattctctggttcttggtattcatcataactaaggaggcaagggaaccccgtgacttggttgggatgcagaagccaaaactcatccatttcaggataaagagcccaggataagggagaatcataaatgaaagacaaagccagaagaaatcccactggcttagaatgaagttgatggtgaccaggaagattaaccctttccaaaatataatatggacacgtaatactctgttgatgaacacaagagtgcctatacatcattgttttggttcattactgggagcagggtaaaaagattcctaaggtctacagtaagtgagcttagtgaaaatacaccccaaagaccagagggaaagctctggaaactgctggatcatcagatcaatagactcaaagatgactaagttgggaagctttatgcagtttaaacatttgtgcagggagtatccccacacagccttttattgacagctacagatcaatggtaatttttgatcattttcaacttacataaacctattgaccccatggccacctttggggcacttcaagtcatcaaaaataatcagaggagatggtgtaaaattgtcagactgctgaagactccaagtagttgcatatgtccccaggagctgagtcgagaggttaaaatatagttcaaattgccagcagaacctcaactgacagagtgttccagagagtcttgtctttatgtctcataaaatgaggcactgatttgtatccaaactctgaccttcatgcatataaagttaaagaaggaaaaaagaggctgaatcccattgaagatattagattgcaaagaatggattattcctagtaaaatatttcttcctgtttttctttgttgagtcatcttcttcatctgctgcctaacaaaagtagctgacatgcttgtagaattacgtacaatatggacgtggacatagaatgaacaaagacaaaacagaagcaagtgcaaggtggcaggccagaagtcagggacaacaaaaaatgtagtcaaaaaaatcattaggaagagtgaaaggaaggaaagagcaaaataatggcaataaaggggaagaagtaagagtattgaattaagataatctctatagaggaaaaggagtgagagaagaaggaaagggtgaataagaagaaagagaaaggaagaaacggaagaaaagtgaagcaaaggagtaaaaggaaggaaaatcgtctttagtgatgacttttcctagttagtaagacagaacgctacatctccaaaggaaggaactgaatccaaaacatctaagatccacagtgctcaagcaaatatcctaaatttaagaaaaataacaagaaacttagtacgtaaatgagagccaacccaattcacagagtgaactgcatccaaattttgcagcaggattctaaaatagtgaactttgatgttggaaattcattcaggagagaataatataaattatttcctaaaacgtcaaagaataaattggcaaggattatcttgtcatttttatgttttcttcattttttaatatagcttttactaaacattgacaaaaaccatggctattgtttagatctatttaaggagtctatatgtggtttgtgtgtgtgtgcgtgtgtgtgtgtgtgtgtgtgtgtgtgtgtgtgtgtgtataaaactattcaggaataacaaagtagccagatgcagcagtggcttgcacctgtaatcccagcacttttgcgcagccaaggcagaagggtgacttgagctctagagttggagaccaacctgggcaacatagtgatacccaatccctacaaaaaaaggaaagaaagaaagaaaagaaacattttgttttaattagccacacacggtggtacatgactgtagtcccggctactccagaagctgaggcaggagaatcacttgagcccaggagttcaaggctgcaccgagccatgatcatgccacactccagcctaggcaaaagagccaaaaaataagaataataataataaattaaataaataaataaataatgtaatatgagaacttgtcctcagtataatttcatgatacagaaattacttttacatcccaacatgtggttatttctctcccttttttttttagatacatgtagaccaggttaagcaaaacaactgttgtaatgaccctttgtaggagtatacccctaaaaattttctgtgccaggcatgcatgaacttcagcttgcaacctacaggccatatttctatattagatggtggaggtttggaagctagggcattttgaatacttctgctttcaaggatctgagccgtaaatgtttattaaacgaatctataatgaaatcagttttgttatttttttaatggttgcctggagtgtgttggatgactgaatgccagttgttaatcattaagtactcatgttaccaaaagtgtttgatagtattgccatctaggggctgaatggaattctcagctctgaaataaattataattgagcaggtgcagctattgacaatatacatatgtttttgctttatagcccacatgcttttcatgtttcttatgacaaaagcttatgaaaaaatgtcccccagcagcccaccttttttatatataatctgttagaggtgattactatttgctttggagcgtatgcttttttggcatctattactgaatattctgaacaaagaattattcttttttgcattattaatcttgcccatgtttgccctatttccacagaaaaggaatcatttatcagaaaagagtgtttgtaatcgggacttgtagcatcttcagatttaatattcattatggtcattctagttctgtgctatatttatctaaaaggccaatccaatgttatggagaaataagtttttaaatatttatgatctaacttttaatattttaaaaaagagaaattagtatttctgtaaaatttgtttcagagtctgattgctcagcaaatgtttaaatattaaaagatttcaagaggttagcgtgtaatatcataatgggacttattgaaataggaaaattgactttacaagtttttgatatgtgaaggaaattgtattttctctgcctatgtttaacacataacaagaaataacacagttaaaatatacagccaataatgtcagaaaacagcaccaaaacctatttctacattgttttgtttttgtctaaccagtttgtttggaaaacaattctgtttgattttgtcatcttgttttagattttatccaaaatgatatttggatgcccccacacataattttttctgatgttcttgggtgcctactttcagaaataactttcactactccactttatattcttcttcccttgttcatcaaggaaagaagacaattgaagaccatgtatcacattcaaacatctaataaaccaaagcagatcattgaatgtaaatatcctactaacccagtcaaaactttctcatgatttcttatatccaatggggatggtacgcaacagaaaatgccagtgtgtgtgtgtgtgtgtgtgtgtgttcgtgtgtgtgtgtttacctatgaacacattactaccccacttgcatacataattcctactttaaaaggacatatcctttcagtccagatgtggaaagagcaccccagggcctttagaaacattaggattcttagctccagtttagttatgccaaatatgttaatgctgctctccaagcagaaaaacaaacaaattttaaaaatcctaattaggctatccctttttttcttttcttttaaagcaacaaagaccaaattctccaagcctagctaacaattacttttggtaggtttcatagttttacttatggtgcttttaacaaatgaaaatatttttatatctatattaataatagacttctctaagggtgtttgtacatgtatagttgaattggcttgttactgttttcttgtgtttatttgttttattgaattcgtaagatatatatacatgccaagagaatgagagagggagactgggaagatggagagtcttgtgtacaaacagatttggaaattaggggtgttcaggttaactctccaaacccttaatattaacctggcaggcaattatcccagtctcagacatgcagcttggcaccactgatttccattttgagctggatgcagcactgatctgaagcatcatgttttgtttttttttttaatgtttatatatcacacgctttgggctgcaagcactgaaaagtcaaggatgctatctggtccactttctgagtgtctgaaatcatacaacattgggtaatatattcacggtgtcaacaagaataagaaaaaatgcgttgttttcttaatgataattcaaaactctgctgtagtgtttgcgctgctgttgcctacaagctttggccatgaggttcagagaatgactttccagcaatattgtcagtttcaaaaaaaaaaaacaacaacttaacctgttaattttcttacagggaacaagccatcaagcccacctgtacgggttagaaccattcacaacatatcgcattggtgttgtggctgcaaaccatgcaggagaaattttaagcccttggactctgattcaaaccttagaatcttccccaagtggactgagaaactttatagtagaacagaaagagaatggccgggcattgctactacagtggtcagaacctatgagaaccaatggtgtgattaaggtaatgtctaccctgcataagaaattatgtttggtgttctccagataaatagatgagccctgacatgccatcaggtcactgtgggaaaactcccttcacagcctgtttaattctccttgatagctcctccaggcacttaatcatagatcacagaaacctagcttagatgtgtgatgcttcctataacccaacactgagctaaatgctctccatggattatctcatttaatcctcacatcaaccctactaggtgggtaccaccaaacctcatgaggcatatgcaggctaagtaactgcccaagcctacactgtaagtaattgagttgggatttgaagccaggaactcacatcagaactgaactctaaatgactgtgttcttactgcctcctgaattaccctacccagttatttgcttaagacttgcctaatttatgcttcaaacagagctcattaagcaagccacaggtgtctgctaacttcccaacttctgtatgtagccgtgagaaacaatgttataaatgttgtatacgtatctcaagctctgccagcccatgagtacagggggactgtattttcatgaatagcctgcattttgatgttttgaaccttcagccacacaaaaaccagccttcatctacctctctgatgttcctccccaaggatggtggcagacatacctgttagttcatactactgcctttacctccagtctctcctggccgtggtccatctcttaggccctcatcaactaccttctgcgggctgggactgcagagtcccccagcctgcagctgctatagacacactacccttttctttgccactccttctccaagaggcagactcccacatcaattccacatcacagggttgagactaagctgttacttttaataaagcctccctgaaaaccctaagagagggatgacagcaggaaattacgtgcagcaataactaagaactgtaactagagctcacagtcccaggtccatcctgtgggctgcctctctgcctagcttcaaggcctgctgcaagtagcagtagcaagctgcttcccaccagcctgcctacatgtggacagaagccagacttctcccccctggggcaagaggcttgagccttaggattcatgaccttaaaatccaaatcacggccccaaggcacccatcagaaaagaaagctccttttccctcaaagcacttctccttgtgggtatttggagtcatgagagcatctgcttcttggtggcataattgacaataagaatattgactccttggacctttatttacatttcaccaaatattaagcaaatatttggtgaaatacttctactaagtgccatatacttattcaagagtgaacaagacagtcaggttccctgatgttacagaccgtgtgtgagtgcacgtgcgtgtgtgtgtgtgtgtgtgtctgtgtgaataaatgtggcagagtatatgaatggtgggggtacagaaaagcaaacaataagctagtaaataaataagcaagggaattactgagagcgatgaatgctataaagaaaattaaatagaataatgtaattatgcctgctcaggctattttagaatggaatatcatttgaatcaagttgacatttgagctgagtcctgaatgacaagacagagttagtcatgtgaggatatgggggcaaaatgttccagacaaaatgaacagcaaatgcaaggcctgaagccaggaatgaacttggtgtattcaaggaaagagaagaaagctagtgtgtatgaagtatttgggagaaagaaagatggcactagaagaggttggagggactggtaggagacagattgtcccaacattgtaggctgtggtaaagtttagaatttgttccaagtgcaatgaaaaattactgaaggctttaagcaaaggaatagcatgatcaaatttacgtttttaaaaatcactctggctaccctgtggaaaatggactatataaggaccaatggagtttgagaactattaaagatttcaaggtagaattgaaggtgggtcaaattagagtagcagttgtgaaatcatgcactataggtgaatcgaagatacattcagaagatagagatgacaaaatgtgttaatgagctgaatgagagacatgaaggaaagggagcgctttgagatgagttttgggtttaggctttgggctattgatgaggaaggggagactggaagatgaacaagttaggagcaagtagatagtgtgaggtacaagtctaaaactcctgagagtgttctttgctgggataaatgttcagaatccgttagcaggtggatgttatataaacccatggtgccagaggagatcagctatggagagaatgtaactcaacctgttgagagtctgggatcaagccctgaggcataaatgtgggggtcaagaggaggaaagagagccagcaaagactgataagagggaactaggctagaaggaaaagtgcatgagtggagtgtccaaaaagagaagagaaaatatgccaaaatgttgctgagagcagaagtaaaatgaaggcagagaagccaccccgagtatagaaatgaggaggtcactgtgatctcgacaaggagagtatgcagtagaatgggaaacctggttggcatggctggttgaggagagaatggcaagggaggaagtaggacatcaactcattaaagccatttagatgaaaagaaaagcagagaaatggagcaataggtggagactgtgggatgggaagttttatttaaaatcattgaaaaatactagagtacatttaaacacgaatagaaataaccagtagagggagataaactggtgacgtaggagataatgagaataacggcagtagtgaagtcttggggaaggaggaagggatgggatacagcgcttaggtggccttcagtaggtacagagatatttcattcatagcaaaaggaggaaaagcaaatcatgtaagtctagattcacatggatacagaggtcagaatatataacatggaggcattcttctctaactgcttctattttcagtgaacgatgtggttatgtcaacaatcaatcaacggtgagggagggaagagggtgttagtggttaggggaaaggaagaaatatgaaataatcacctgggaaaatgacagagcaaaagcatgagggaataaaataggattacaaattggtaatcgcctatttaaaatgtatggatagaagtttaaagtgagaccaataaaaatgtttgggtgtttttctacaaacccatttcagagcttgagtatagagggacagctaaattttacactaattagagatttgccgggtgaatatcaggggcagcaaggggtgcttggggggtcacagaggctgcaagctagttatggaacctatgctcccttcagaagatatggcagtccccttcccacatgggggtggtcttgccctgggtcctcaacaagaaaatcacaccaacatacaacattccaacataaagaggtttccaaacttctaggctgtgtaatcttagggaaaaaatggagtatgttaacaatttagtctaaattaagcttgcccaagaaccacttctgggaatgtttcaagggtgtgccttccaagggctgtaaaatgtgtcctgtcccctcttgagagtcaccatgatagggagtcatcgaaaggagtgtgtcatctctctcaggtttgttggagcaggaaaaggttggaaaatcactgttcaaaaacacctgcattcagattaacttacttcccatctttcaaaaaaaatgaaaacttgctctacatttgtacagtataataagcattcagatgtttttttccagaacaaaagactactttgcccccaaaggagcaatcagttcttccatggcctggaagagaaaacagggtgtttttttccatcccctagtcataaagatttatatacatgtatatatgtacatgtatatatatgtatggatatttgtacttatgtataaaatataggtgtctgtgtgcctaaacacacacacacacaagcatactctttcagccctggcactctgtaacaacaaatgattaagcgttgtaattccatttcccagcaaatgccgtggaaggtagaccctactttagtcagtatgagatcagaagcagttcatatccataaaacaggagactttaatactattctctactttaaaaaaatacaaataggagaaaccttgtgaataccatttaagtcaaagaatctgattcaatagcccttagttttgagataaatgtttatgtagttcccaaactgaaaaaaaagaaaagaaaaaggcaaagaaaaacattgtttgtctctctgtgggccttatgttaactgaaaaaaatcacatatccccaattaatatcagaatacttcttctaaattagggtcatcaaaataaggaacaagggggtgaaggttaaaaaggggctaagtaactacacaaagaaattgtatgctgcaagttatcccttttgcttctgtccttctgtagacatacaacatcttcagtgacgggttcctggagtactctggtttgaatcgtcagtttctcttccgccgcctggatcctttcactctctacacactgaccctggaggcctgcaccagagcaggttgtgcacactcggcgcctcagcctctgtggacagatgaagcccctccagactctcagctggctcctactgtccactctgtgaagtccaccagtgttgagctgagctggtctgagcctgttaacccaaatggaaaaataattcgctatgaagtgattcgcagatgcttcgagggaaaagcttggggaaatcagacaatccaggccgacgagaaaattgttttcacagaatataacactgaaaggaatacatttatgtataatgacacaggtttgcaaccatggacgcagtgtgaatataaaatctacacttggaattcagctgggcatacctgtagctcttggaatgtggtgaggacattgcaagcacctccagaaggtctctctccacctgtgatatcctatgtttctatgaatccccaaaaactgctgatttcctggatcccaccagaacagtctaatggtattatccagtcctataggcttcaaaggaatgaaatgctctatccttttagctttgatcctgtgactttcaattacactgatgaagagcttcttcctttttccacctatagctatgcactccaagcctgcacgagtggaggatgctccaccagcaaacccaccagcatcacaactctggaggctgctccatcagaagtcagccctccagatctttgggccgtcagtgccactcaaatgaatgtatgttggtcaccgcccacagtgcaaaatggaaagattactaaatatttagttagatatgataataaagagtcccttgctggccagggcctgtgcctgctggtttcccacctgcagccttactctcagtataacttctcccttgtagcctgcacgaatggaggttgcacagctagtgtgtcaaaatctgcctggacaatggaggccctgccagagaacatggactctccaacattgcaagtcacaggctcagaatcaatagaaatcacctggaaacctccaagaaacccaaatggccagatcagaagttatgaacttaggagggatggaaccattgtatatacaggcttggaaacacgctatcgtgattttactctcaccccaggtgtggagtatagctacacagtaactgccagcaacagccaagggggtattttgagtcctcttgtcaaagatcgaaccagcccctcagcaccctcagggatggaacctccaaaattgcaggccaggggtcctcaggagatcttagtgaactgggaccctccagtgagaacaaatggtgatatcatcaattataccctcttcatccgtgaactatttgaaagagaaactaaaatcatacacataaacacaactcataattcttttggtatgcagtcatatatagtaaaccagctgaagccatttcacaggtaggtagccatgtctcggttttctgagagtaagccactgctgacctttctattgcctgagcccttggtcagttctaatgaagactctaaaaatgggatgcaaggtgtccccaacctccatccacctaaacgtgcatagtagacaaagcacatcctcacccaagcaaagcctgcttgcataacctccagagagcagaattctttcaggtgatgttttgagagtcagtgtttcagaaaggtttgcaatgcatcctggtatctgaaataagtaggacagagatgaggctagtccccctggaaatacgcaggcccctggacagttctgacagccccgatagggtcatctggccagactgtgaagaaaatgatgtattattttaaggttaaaaagtgccaatcaatgagcgcaattaccagccagagttagactaaaacaaaatttgtttcgtgaagagccttcttatcaaatccagcacttcttccaggaataataaggcttctctgactctactttcttatggtttctcaggacagtgccactttgctagctcatgttttcctagcggtcccatctgggctctgtgacatgcatggaagtgcgttgttctccacacaaaagaatcttgcccattgtttaaataattgtttggcagttttccccatcacattttaagtaacttacatccccagagagaagggtaataagagacattttatgcttaaaatttagtaaaatgaacagaatcacttaaaaaaattaaaggctgaaagagtgttgatttccaactacctcaggtaaaattcagctattattgtaatctagtgatgtgtagattagatcctcctataattacctctgatatatagtgctgttgaaatgaaacattcgtggttttatgcatctactcatgacaattatttagggtctattaaatattaaacagtaattaaaacttcctcaggtatcctctgcagctaatccacatgctatgtgagttggcttttatattaccttacactgattcagggcattaaaaaggtccactgtagctgcagagctgtatattctagactggcttcctctttacctgactgtacctccaactttcaaaaaccatatcaatttgctcccttttgaaactcttattcaaaaagtattctagaggtgaaagagtttgtccaggcatgaaaggaatgctttttccaggctggaaagaaaagtttaatttatctgataaattgcaaggatatttaagaatgtgagagaaatctcttcattatccactctaactgaatctgtaagtggcattgacataaaacagagtatcacttctatatgaagttggagttcatgcgtggttttttgtttttgtttttagtggattaatgttcactgaatattgcaaatgtgtgtgtcctcctttcagcacccccagctggtcagtaagaagaaatagtctgggaaagtcctaagtagcagaaggaatccagcccaaaatttaaaaactaccacggataacccagaaaatgaataatctttatgtgggaaatcaaaattgacttcacagaattgcttagaagtcagatctaccatacacagctatggatttgatcaccaataaactggtagccctgtcatggtggagatcggcatgagaggagaaccaggggaggaggagaagaaagtgggaataaaataagtcacaaagggaaaaaggtgtaattaagaaagcaaaaaggtggaagagacagaacatgtacaagaacagaaagcagtgattcaaagagcaaagaggggaggtagaaaatagaagaggaaaaggctagaactaaaaggaataaaggtagaaagaagatagctgggtgcctgcgggaaaattgaaggtgtcataaaatcaatggtggttgggaatagagaaaaaagtgctcatttacagccataggcactaaatactcacaaaaactcattttgttggaaaggagaagtccctgctatgtaaatagaccttttcaagtagcagagaccagctatgaggcaaaacataattgattagttgaatttaactggatggtgataaggtgtcttcatgattgataatctggtgtgtagttgggttaactttggccccgcaaggtctttgtatcatgtaagggaggctgttttaagctgttaggtatcaggtgaggggatttattaccactgagaccgtaattccatgatgttccttcatgacctggaaacattcctgggggatcattccatgatgttccttcatgacctggaaacattcctgagggatcatttagctctagctgcaaaggtaggagtccaggactgctgagaactgcttcatactttctaaggtctgcattcttcattgctatgttaagtaattctgaagagtaccagaattttcatgccggaaagaatcttgagagttatttattccatacatccttgtttaggggaagaattgcactcacccctttcgaacagatcaggaactttagtttagaaagccagggggattttgattgttcaaaaatttccatggaaatataatttttttttgagacagagtcttgctctgtcacccaggcgggagtgcagtggcgcaatctcggctcactgcaagctctgcctcccaggttcaagccattctcaactttgttattcttaagaattagctgtgaataagaatacatgtaagcttgtcttttttttttaaggcctggtgttttaaagattcttcccatgaaaatctattttgctgaaaatcactaatttctgccttatgtcctgaaggtatgaaatacgaattcaagcgtgcaccaccctgggatgtgcatcaagtgactggacattcatacagacccctgagattgcacctttgatgcaaccccctccacatctggaggtacaaatggctccaggaggattccagccaactgtttctcttttgtggacaggaccgctgcagccaaatggaaaagttttgtattacgaattatacagaagacaaatagcaactcagcctagaaaatccaatccagtcctaatctataacggaagctcaacatcttttatagattccgaactattgcctttcacagagtatgagtatcaggtaagaaatgtgtattataaacaattcgagctgattgtttgcacccgtcagcacctgcctgtaaaaatggtgcacaatttgaaaaggcacttaaagaaatgtaggacttaaggagaataataatattccttaaaaatttttaagtggtaaatgaggaaaaaccatgttcattgcctttttcattttcttggtttttgagccatattatatacgttgtttttcttaagtagattccaggtgaatttgcatttcttattagtaaagtggtttctgccattaagattccctctgtcagcgttgccttggtaggagacactccttatttaaagatcactttgaaaataactcattactcgtaccaaaataaaatcaaatagcaaacatctctagcctcggtgctcaagaaagatacagaatgttgaaaaaagtctagaggaatacaactcacctgcccatggcgatgagttaagttttctctgaggatggcctaaaaaaataagactgcattcttaaaaagccaagaattaagaataatattcagaaaatatggtgaattctgtggaggacttctgttaggtttgttttgttttgccatcagagtccatttgcattcttcttgtgataacaacctcatttcctgtgggagaatgtgcttcccccaccctttgctcaggcgtggtgggagtgtcaatcaatgtgtcaggctgtcttctagccaagtggtgggcacatgagccgctcagcccctcagatttgcctggggcttgatcttcagcagagtgactcagaattttaaaaggtggaggtgagaagtcgtgataaaatatccctaacctcaatctaaaagtttttcttttccctgctatttccaagcatggttcttcaaccgttcttttaattccataaactcacagtaaattctcatttgcttaagtcagaatcagtgcctcttgcttgcagtcaaagaaagcttactgactgatgtaagcacttaagtgccaggaacaatgccaacagaaattttctaaaagaggaaactgagccttaaaaagcttattataacatgaaatactaaaaataataagtcaccaaaaagatagtgaccaaatcaatgagtacagtgaatacagggaacattttaagcatgaaaagaatattttaggacaataatgtatgggacaaattaccgaattaataagatttaaaaatataaataaattctcgaatggtttggaaaaatacacagatataaatccataatcccttgtttgcaattccaagtctaaaaatctcttaaaagtattttcttgctttaccacaagtcatttggcaacaaaacccaatctaaacagacttgagactatttacagtatttatttatcccatttaatatgaatatttatatgttttgctacaaaaatattgctttattataagatggctaatcagatcatggtatggatattacaaaatatacagtatatacattttatcctatttcaaaatctaaaaacaaaattattttaaaacacatcaggcccccaagggtttaggataagaattgtggtttatgtcataaaggaacaaaatacttaccgatgccaccatcggaaacgtaacactgttagaaacagccagaacctacgtgcctgcccttttgttcttttctcattacctttattgagaagtgtcacgttatcaagctgtcagttatctagtctcccttacaaataaaaatggtaccttcgtgagagagctggatgaaatcagcataaaatcttcagccgctaattaaacgcaacttaatgacccatatataagaaacacaaactttctctggtattgtgttgtgtcattgggttaaattctggtcacatgatctgtggaagtctcattccagtttttgtttgtttgtttgtttctttgttcgagacagagtctcgctctgtcacccaggctggagtgcagtggtgagatctcgagatctcaactcactgcaacctctgtctgccaggttcaaacgattctcctgccttagcctccagtgtagctgagattacaggcatgcaccaccacaccaggctaatgtttttttgtatttttagtagagacagggttttgccatattggccaggctgatgttgaacccctgacctcaagtgatcagcctgccttgacctcccaaaatgctgggattacaggcatgagccaccatgccaggccccatcccagttttctatggaatggaaagctccaagcatgtgccttgtctctagtcagatttttcatcaggcactaaggatgactaagaacaaagggacccacatttcagaggagaggcaagttaagaaccttaggctgtgtggtttcttttgtaactgttactatcggctctgtgttacactcctcctccatactcatctcactcaaatgaaagtatttaatttggtttttgatctccaatttttatttattagctaatcccacgtagttacaacataaggatagaaaacaaagaaaatcaaaatctagcttagcccaaaggcccagttcttatggaaaataatattttgaaaagcatagattaaatgctgaaataaatgatcagaaaatattagtttcatttagcctgtgtaaatattgagtctatgtggaccctgagtaatcttacagaagtcatttaggaagttatatactaaaacaatttatttttctttaacaaaagagcatttttgtatttgtgatgaatttgcattgctctcaaaaccacttgagggttacttcatctgcaagtggcctttgaaaataccttcattgtcctatataaatctgctcacccagcaactgacagtgatttcacccttctgcagaggagtgtgtttttgaggtaattgtagattgtagggaataaaaacaaagacctgagaaacttcctagcagtggggaaggattaatcagaagatcgtgaggatgtatagttggggaggttgccacccacatggtgtgccttgcaagtatcagctggggctccccaccaccttcctacactacattacatcattgtactcatttctggttttgagttaaatcattgaaggcagttgttaaaatttagttatgtgaaaagaacaagacagttttcactagtctaaatcaactcattccatcagttggccagtgatagaagagggtatcgcatggataagttcttttgtttttctttcttcttttttttttccttcttctttgtttttttccttcttcttctttttctgagacacagtctcgctctgtcacccaggctggagtgcaatggcacgatcttggctcactgtaacctccgcctcccgggtttaagcaattctctgcctcagcctcctggtagctgggattacaggcgcccgccaccatgcgtggcgaattttttttgtatttttagtagagacggggtttcatcatcttggccaggctagtcttgaactcctaacttcgtgatccacccacctcggcctcctaaagtgatggatgagttctaacgggcaggagggtcaggaaatatctggagaaatggatacttatagagagggaggagctactcactgcagaaaaccaaagagggaaattaaatgagcagcaaatgtcactcacctcaccacaattcatataaccagcttgataactagctcctttgaaggtgagcaaaatccatgtgatatcacaagcaccttctaagtgttcactaatacttcaatatggaatgccctaaaggtagcatccccactgtttacagtacaagtggaggacctaagagcttgttcaaagggcagactcctgggtggaatgggaagggaccccagcaaccagtattttttttctttttttgagatggcatgtcactctgtggccatgctggagtgcaatggcgcaatcttggctcactgcaacctccaactccccggttcagtcaattctcctgcctcaccctcccaagtagctgggattacaggcacacaccaccacgcccagctagttttttgtatttttagtagagatggggtttcaccatgttggccaggatggtctcaatctcctgacctcatgatccacccgcctcagcctcccaaagtgctgggattacaggcgtgagccaccgcgcctggcctagcaacctgtacttttaacaagcagcctggatagtccacaacccacttttttttggaaatactgcctcagagggtgagacattgctgctatgctacttaagccttattttcaagcggtgattttctgaatcagtggttctcagctttgtgcattagaatcacctggggaaatttcacaacattctgggtgctgatacccagtccccattcccctgtagttctgattctgggatgggttctggaatccctgcgattcaaaaggttcccaggtgattctcatgtgcagccagagttgagaatcactagcctaaactgtcataaacagcccaaataagtgaagccagctccccacaaatgcctaatttacatgatgatcattgataatagcctattgacgttggtctatcctggctttcctaaagaagggtcctattgttttgatgtgaaactagaaaggagaacagaatatattatctacaaagtccatgtctcagctactcatataatttattttaatcttcctcatggattttatttggattttgttattgttgttttattttcttttgtttcttacttgggaggtccggtctttggtggtaagagtaaagttcaccatcatttaaaacaggggatttttctagtttgagtcatttcagcatagcttccagaattctgggattctgaaggataacactctggaggattagctttaataaagccagtgagatctaaaatatgaatcaaaaaattaggaatattactttttcttgttttccacaagaatgggttggtggctttacagagtgcactgcagggtcccattagaaagcaaacattctctgtgaatttcaaatgcaacttagtttaccaaaatctaattctcaaacaaccctgtgaatgtatgttccatgcataaatgcgatgcatctgtactaaataaaattcttccattgcacagacctcttccttaaacagagatcacagtcttgcttgtgctacagaatatttacaaatccaagaagatttttttaaagacaataatcatttctatcttcaaccctttcaaaattgggctattctaatacatgcagtgtgaacctccaaattctatgtggagcagttcttaactgtttagcagcaaattaagacaatatttttcccacaggctttgagagggacctgggtgtgagtctactctgttaagacattttggtttttacctttggggagtgagctgaggctaatgaatagctctcagtaattgtgcattcatattcatactcttgcttaaggcaaagactcaccacggatttgatagggcccgccaccaccccccctttcactgattcatgctgtcagtgacttaattagttttcctgaaactatctcactttgacagatttttgcggtaagcacccacgcacactcagggtctctgaagcattctggtgcctcatgactgggtgactgagaagcagtaggtcagtcttagaggaaactctgtgactcatggcatggggtctgaacttagggctagtgctgcaggagcccatgcagaatggcagtctgctgctttctaacagaccaacactgcccccaaacaagaggatggaaagaagggctgtggaggagacacagaaggggatcctcactgttgctgccagtggcagctgcctgaagactgccagaggtactgtggaggccttccctgcaccagcccccaccataggctaccaaatcgttggcgatgagttagaagtgggagggagaaaggccaacatcttctactccttctctcactacttctggatatttgagcacattaacctctttgggcctttcctcataatataaattaggcctgctatgatggaatatcatagactgggtggctttaaataacaaatatttatttcccacaattctagaggcgggaaagtacaaggtcaaggcacctgcagattcagtgtctggtgagggccaccttctggcttacagataatggtcttctccttatatccacatataccaggtagaagaacactagtccccttcatgagggctccaccctatgcaacctaataacctcccaaaggcctccataccatcatattcaagattagccttcaacatatgtatttgaaggggacaaaaacagtcagttcatagcactcatctataaaaggaagcaccctccagctctgtattctatgggcagagtagtggtaagctacaggtatataatttttagaaagtctaatcaaactttatcttctcttgattggtttttgtaatctacagtttgtaaaaccctacaaaataaattctcacccaaagcaacagaattttctaatggtatttagctttaagttgtgttgatgcaagtgaatgtatgaaatcagcttcagataataaatggatatatggttattcatcaccaagatggacacatggaaatataattagttgtgtctctcattgaaacctaacatatttattcactaatatattttttaaagtatagctatattataacatatgaatgtaaataaataataaacttatttagttagctacaaataagtctcatttatgttcctgagaaaacccacactatcaaaaagttgtcatgactatttcactacaagtaacagaaagccaatgtaaactaagttaaacagaagggaattgtttctgctctcgcatctgggaagggcattgaaggaatcccttgaaaccaaagaaaagatatgaacaccaggtcctggaaacctgggatgcaggactcggatgatgtaggattcattcattctgtccctccttgccccatctcagcttgtctctgtttggcttcattctgcacactttcaccaggcatctgaggaaatcactcccagattcaagccctttctgtgcatcagttttcttgtctttaaaatgtgaatagatatagcattggactcataggcttgctctgaggttaaatgagttaatatgtgaatgtgcttggaacagcacctcatacatagaaaccacttcgcccatataacaataatgattattattattacccatccaccttagagtggaaagaggactataagtcaaccaatacaggactctgactgatccttttgcactacctgccttcctgtgaaccaagagaacagaggactatgattgagcaggtgtggtcgcagggcccacctcctacaggcagggctgcatgaggtatgcgggaaatgcttccagccagaagcaagaactgccctagcacgctacacacaccaaccacgggaacaagtactccacacctgtgagatattgacaatccttgtgctctttcacattggatgctcacacccttcctgttttccaaatgaagaagctgagttaagatcacatagcttgtgcaagaaagatacttaatttctgataacttcacctttctcatttaaaaaaatgggtgtgttatgagaactaagaaatctgtgtgtctagtaggatgcctgctacttagtaggtccatgcccccatccgatccccccaggatctcactagttaaaagaaggagaaactttcattcaagactgtaaaaaagccaggttaagacatttcttttgtctatatcaacaagtcattgataaaatgttagagtgtaaaaatctcaatcaggagtacagttgcctctaaaggtgtgatactccttccgctaggaagttcaaccctcctcatccttgccatttctcttctcagaaaaagagtaatttacccacatacccatgactaaaattccaaactctgatagtctgactctacttttatgcaattagctacttgctttgtattgcctgttttctattgctgtcacccttaccccatctcttttctatatcacatttagagaaaacatattgaacacattttctgtttagttttggacttgcatttaattaggtattaatctcactaatgtatttccgaccagcatggaggtttttgtctggttaatttctcccacaagaactaagctccccacacccaccccaactcccacagctcaaggttttaaatgatttattgatattgtctgactcaggcagtgtatttattctaaaactttagggcctgagtgcacaggttagactgaaggccactgggacatttccatgtatagaaaactaaagttcgccactaggcccagggcctgatcattttttgcatcgagccttttgttcccacgggagatcatttccacctgtcagtgtgagcacattcaggagcatgctctaattctttttgttcttgttccatctctcatggcaacccttaggactttattctgaagcttctgttgttggcaatcttcatggcgcctttgggacaagttatccatgtgaagatgggttggttctcaccctcttgcagatgcaactcagatttatatttcacttaaggtgatgttgatcttcctgtctctgtgttggaagtttgtttgctgaaaataaaatgttaaacacaacagatgctcttcaactgaatgtagataatatgccattccagcctgccctcatggctcttcagatggccatgaaaacaaaggctcccaaagtcacctaaaacttaggtcctgtaaaaacatctaggaaagggtaagatgtgttttacttattttcctccatcctgtaaattgagtatttaataaactgtccttattaagcacctacaatgttcaaagtgtatacctagttactaggattgaggcaggaggctaaaatccatgcactctccccttcagggacttaaattatagttgataagtcaaataaagatgcccatgaataatgtatccataaaaatatggctaggaacgttgatgtttgcaggatctgagtgatggcaaaacagacccagggaggaagaagcagcttctttatcttcagggacagcacgatttccacaccaaactctaaaggccactcttattctactctctggccagatggttttgtgcaggacaggtggcaccttgatattaaagaggtacttgactaaaatcattccacagagacatgaaggggcaccatttctctgttccttcagtcttacaaaaagaaatccctttctaaatctccatccttatgtttagaagcctctcttagcccacctactgttattggtacccatgtaatggttcaaaatattctccactgtatcaatcgggatctcagcaggaaacatatggcacattcaaagggtatttgaagaaaatttaatgaagaggctatttatggaggtgtgggtagaattaagagaatcaataagggatgttgaagtacccagggagtaggaagagccagaagctgttaccttctaggcctgcagggacaatggaagaaagtgggtcattgagaggaaattcagccttgtcaacatgcagtgccaaagagaggagcaggagaaacaaagaacctgaactctctcttccctttgatcaaaacctaatggaaaggagccagaggagaaaagattccaggtgaggcagtctgatgaagtcagcattccagagtacagaccaagccagagaagggcagaggatggatctggggaaaaaccagctcgtcccccacactcagattgatgctgcttctcaaccagtatataataatgccttcaccagtagaatcctttctgggctagaggatcacctggccagctttggcttgtcaatctatgattattgataaaccactaagtaaatctgaagacttaaggaggattgtacttaagtacttgaaccaacagcttattacctttaaattgtaaataaacatctcaggatatatgaagcaatctaatctgcaggtggaaacaaaaatgttaacacattcaaataagtcagatgccttaaatggtaatttgtaagaacatagttgagacttcttcttgttaattgatttatctgttgatggagctgatcattactaatatgcctataagcatctagaaaactgtacggttctctctttgattcctataggcatatttctaatggaaaccagtaataaaattcttttctctaaagaatccattgaattgctctaattttttcttttgttcatgtttgaggactttttgagaaattttaactaattataaaacaaagtagagaagccatccaattaacaaatttcattgtagagcaatatttttgaaaagccaggcttttatttactctaaccctcaaagctctacagtacagaagtacctggaagaaagatacacagggaggtgtgggctaaattccaaatgctgtggggagttttccaatcttattaatgtgtaacaactaactggaatccaggagtgagttgcacaattgctatctagccccactagatcccccaaactgttaagtcattctctcctgtcttttcacacaaataatgtgatagtaatcactattatttatttagggtttgctgtgtgctaagggctgtgttaagaactgcatgtatattaactaatttaatctcaaacaaccatttgaaataggtgttattactgacactattttacaggtgagaaacatgaagcattgaaaaattagataccatgcccaaggatatagagttgataagttgaaggactcaaattcgaaccttaagattcagtttcaaagactggtttcttaaattctaccccaacagttacctccaaattgcatttgtatgcagctttgggactttcaaaaatcaatgaaatatttataaatgtattcatcccctaccccattcctcagaaatttctagaaacaatattgcatgtaaatcttaaaatagtcctgtgggatagatgttgttatttcttagcatagtcaagaacctgaatgatttagcaagttacctagtcaaaaagcaacagagtcagaactcaagtcctgactttctgaccccaagttcaaggtggctctgctgaactgcagcttcttcaagtcacctctatcaggagcacaaattcctgaccctgtgaagacagaccgattagggttgcagtctaggctacatgaattaccaattctggatcctcagctattaatttaaactcactaaacctcagttttcttatctgtaaaattgagattaaaaaaacaaacaacaacaaaaaaaacttaccccaggaaagttgctgtgaactttaaataagttgactttaaggctagggtattgtcacttacaaaaaaaagtaaaatttaatatataaatacatagaaggtgttcagtatccagcattcctgcaaaatgaaaatcaaataaagtcactctcctactgcaaaccctacttcccccattccataagatgcaaactcctctctagttccatgaggactttcgtggtctcatttttgtccaattctgtcctcatcccattgctttccggcccttactcactaaggtcagccacactggccttcttgaggatctagccttaaggcctttgcacatgcttttcttttccatagaatgctcttccctcagatcttcatctggtactttctgccaattgtttcccagcttgatggtcatctgttgagagaacctcctggataagccaaccattttctgctctatcaccttatgtatatcaccctacaatctcatcatttcctttctagcatatatcctaacctgtttattttatttgtgtttttattgattgcctctcctcaccaggatgttaatgccagccttgttcactgttgtatccccagctcatagaacagcatctggcatatagaaatggctcagtcaatatgtgttgaattcatggatgataaatggtcttacctaatttactatccttcacggagatgttaatcacaattggtgattgtgatcttagcttcttctagcaacttattgtggataaagtatatattttaatgctatatccattagggtatagttattattgcagagaacataatggaatttcaatgcatttacacatgtttgaacaggatgaaatatatgagtagtacttgcttctgtgtaatatgcaatattgctgaaagcatgataagtggcacgagagatggatgtcacgttgtttgtgatagtttcccctgtctcacttttaggctaccctccacagaaaaagccagtccacgcagggctctatgaaaagcccaggacagcaacccacccatgtggaaggtgtgtacaggccttcttttaatggccttatgtaggaagatgtaaagagtttgggcttttatgtcacatatctgtattggaaagccagccttaccacttaccaagttgcataaatttctgtgttcctcagttttctcatgtgtaaagtggggataataataccaaccatataggattgtcgagaggaaaaatgcaaaattagtacatagaatacacttacaaaagtgtaagtgctcaataaaccccaaaactacttttacatatcctccatgagagtcggatgggggtgggttcctgtttcctcttagggagagcagatataagaaaaaaaaaaaagtatgtgataactccaaattttgattatttagttttattgttaaaagtgaatcagggttgggaggccaaggcgggcggatcacgaggtcaggagatcgagaccatcctggctaagatggtgaaacaccgtctctactaaaaatacaaaaaaattagccgggcggggtggcgtgcgcctgtagtcccaggctactcgggaggctgaggcaggagaatagtgtgaacctgggaggcggagcttgcagtcagccgagatcacgccactgcactccagcctgggcaacagagagagagagactctgtctcaaaaaaaaaaaaaaaaaaaatcagggcaaatttcagtatttcacagtgttaggtcagtttttccttcttcaggtattagaggagaaccatattcacaagtattaaatggctccaaagagcaaggcggtatgagaagcagtagcgacaagacacccaattctagcatgggaaatgtcttgttatttttccagtagcttcacgtctctgaacttcaaaagtgctcatggaaagcaagacaatgtcctgctgtaccctcttcccctgggtcccagaattcaattaaaatcacgttctatcttgcctaatccaaagtgttttagatgaagggaacctggaaaacgggactatatctgtaaaagtgtgactgtattgtatccagcaaggttctatgcagatagagatgctggaaaacatccatttgatggtgaaagaaaatcagatagatagacagttaaataaatagctcctagagcttttcagcacattattccttcataactggagcctgcagggctactcatgaaataaaacaatcttgtaatcatgtaatttcaaattcattgcattgtcttttttgccaacattctttaaccgcgattccagcaaagaagatttcagcatattgctattcaaacatattcaaaacctatgacaagctaccctttaagaaggcattagcgtgagtgccatgggaaaatgtactccaaggttgtagatgaattgatatgatctccttgattgtatctttttatttatgaggcataatttctgagcactggaaagcaaactgcaatgagtgatgactaacaacaaccaaagtcataaatcagcagcagtgaaagaagtagtgattttgatcgaatctattgaattagctgttggccttagccaatacaggtattggaaagacctttttaatatctatttgtccccctcatgggaatgtgataacaatctcattacatgcccctaggaaacaaataatttaattgtttgcccgttaacatacaacctgtttacttattaattactggcatagctgttcatgctagattttttgtttatttctgatgtgaattgttacaaaattatgttcacattccttagtttttataaacaattatgtctccttagagcttcttgatataaatttgtcctcagaattgttgaaatgctttttttaatcaaatattgtcattatcccacaaggaagtatgttacagagtttcacagaagttgcagagagctcagatattcttccctctcttaatctctgacagttaacacttttactaatacaactcttgtaataagcagcctggataaagaacaaaaatctcaaattgctccaagcgtaaagacagtcatcatcacttacattaggagttaacagattagagatcttttgtaaaagattaatcggctgaatttggttactcctgtattacaattttatgaggagaataatagcaaatgtaagaccaaatagacatcagcttggtgctgacccatatacaaaccatccataaaccatatattatgaagtatgttcccttgatttgaacaagacttgtagcattgccttggccaaaagaatcataaaatattttcacaatttaggggtttttcttatgataccataaaggaaaaatgcatcaggaacccccttgaaatgtacattaataacttagctttgctgtaagacaatacttggaaaacatcagtcctaaggaaggttatttcagaaagatatgagacattgagcgaggcaaagcattaaggtgaaaactactttgtttagccaatacaggcattagaaagacctttttaatatctatttgtcccccttatgggaatgtgataacaatcttaacaagttaagtgtggaaattgtgctaaaaaataactagcacaggccgggcgcggtggcttacgcctataatcccagcactttgtgaggcggaggtgggcagatcactaggtcaggagtttgagaccagcctggacaacatggtgaaaccccatctctactaaactacaaaaaattagccaggtgtggtggcaggcacctgtagtcccagctactcaggaggctaaggcaggggaatcacttgaacccaggaggtggagatcgcagtgagtcgagatcgcgccactccattccagcgttggtgaaagagcgagactctgtctcaaagaaaaaaaaaaaaaaaaaaaaaaaagaataactagcacagtaacagaagcatccaaagggtcaccattcttggagatttctgatacatttccccttctcccatcctgtgcagactgatggtcccttctctttcccattcacaaaaattattacaatgcttctgttcacaaatgtttgcttttctcctagaataaaattaggaggagaaatgttgggttgagagaaattgggagcatttagaataatgttactctgcactgagagaaaaatagactcagcaatttctagaaatatcaaggtttcaagaaattactccttaagtgaaaattaggaggcaagaagtggttctacaaagtcagtaaactctagttctgtttggaactgtgaaaaaacacagtaattaactctatgatgattattgaattgtgacatattccaagatacatttattgtgtttatttgaatgactaaagttaatgtgaagtataactctaaagagacataacaaatagaaattgaaaatgtacagtgcctatattctgtacctggctctataaagaataggcctttgtatttttcaaataatattgggtgtaaaaagcgcttggaaatatgttgaaagggcagagtccaaggtcttctcaccagaaattctgatacaggtacccaaaatcattttgatgaccatggctaaggaatatattgtgacaaagacttctcttaaaagaagatttctaagaggcaattttcaagagagaacaaatgattaaattcattgttttcacagcaatgtgattatggcagcttagtggcagatgttgacactccatgtaattaaaaatttttaaggcaaaatacaataattagtcctttggggtaggaaagagtaaataaaagaacaatttcatttttttaatgaacaacaagcataaatatggtaatagtctctagttagatttaaaaatatattacattgaaaacagaaattccattgaaaactgacatattaatctatcattttgctagttaattacagaatttgtggctaaacaattttagtttttatgcttattaaaagtagttaatctatgttttctatgacattttacattgtaactttcttcatggttacaacagaaaccttagagaaataaatcaacaagtcagtcagtcctaacttttcattattaacgactagggaagtttctgactctacaatcataactgtgtgtgcacccactcattcacatgtgaaagtgttcaccaaacccaaataataatgtatttcagcagcaactttaatcatctttaatcttttattataaaagaataaatatgttcagtctatgagaacacatggacacagggaggggaacatcagacacagggaggggaacatcacacaccagggcctgtaagagggtggaggctgggggagggatagcattaggagacatacctaatgtaaatgatgagttcatgggtgcagcaaaccaacatggcacatgtatacctatgtaacaaacctgcacgttgttcacgtgtacactagaacttaaagtacaataataaaaaaatatatatatgttcagtctaaacactgtaggaacaaaaatatcctgaataaatcaaagatgaagaacatcttggcttttttttctcttggccatagaatttataagccttacttgcttttcttccccaataataactcttccatttttctaggagaagcccacacactaaagaaagagaaaatacacaactgtttgttcacaagatattttatttattgatttttatatgggttcattgcaactaaaagatcgggacatattgctaaaaagttttctatgtgggatctctgctgcttctttctctaccctataaagacagaatcgaatcttggggcattgtttctcagtgggaatcataagcataacctgttagtatttttaccctgaaccctgaactacacttcaatacttttatctcttgcttagccgggcatagacaaaaatccacagtgatattttagacaaagaacgtttttacctcagcagagacagagacaaagacagagagacagaaggagacagaaaaaatattattcacaggttcttttttccttttctcctagtggtttgatataacagagacactgcctcatcatacaagttttgtgaaattcataatgcttcattatctcagtcagctttctcttcattctgttttcattttcacagtagctcatgtaaataggttgatcctgctttgcataagcatgttgatttatatgaatgctattttgatctcaaattgattgaatactaaaaagaaagtctaggaaaaagagtaatgtattatgaaggactcctgccaaagacaaaatagcctgcatacattccctattagtgatggggaattttgaattgcctggttttcaaagagaatatttccaaggaaatatagcaaaacactataatactgaggcccaagtgtttttaaaatccagggattaaatcacattttggaactagaactccacctagtagaagttcacgtaacacaggaaggctgagatttagtacaatctacgacactaccattaaaaagccttaatagtatttatgattctatatctacattgaaaatgaaagaaaagttaatgttcataagccagagccagaactgtgctgagcacttgctatgaattatgcttatttcatctcattttctttcaacaccctatgcctgcactacttccatctcctattggtgcacagtaattaattggcaagttgttgaatttttcttttattatacctagttgcactttcttcctcattttcctccccatccattgtagcctgaatttaaattctgcctgcgctcaaatcaccaaccaaagttctgctcttggcaaaaaacgtcatatcaatatttgcaccttactttgcattcctttgtcaagaatattgttttaaatcttgtcattcattgtgtaataataggtgtcccccccaccacttcccagaaagatatttgcagtaaaagaggttgttctggggcacagtgaggagacaggaaccctcctcatcagccctgaagtctgacttcttcatgaataacctccacctcccctccctagtgtaagtctgacctcacctatttctgaggggactctgagagcagctgcagttgtattctgatggatggactctaacttccatgaaatctggctctcccattgctagctccttacttccctgtgcttaccaaaacaaacctccctcacctaagacaacttgtacatgtctatccatccttgcaagctaagacaccttaacctaatctagaattgcaggtattcgtctatggacaagtcgtttaattttcatgattctgactattttatttatgcatatggatggcatacagaatcaaaaaccctgctcattgaaacaggcactggagagcagaattcttgtttcagcacttgtaacttttgtcaccttgaacaagatagtgaaattttctgaggctcaatttcctcacctttaaaaggggactagtaatacattctcggctcaccttacaaggtttccattggaaggactaaataagctgacataagttaaagtgctttgtgaaatgtagagtttatacaaatgtgagtgattattatgcaaatgatgagaggatgtatccgagctctaaaaagagcaggtgtatctatgtaagtaggttagttgtctcttttaaaaaatgaggctcctggcaatcctatcagcaaggggctggagatttgcatttgacagcaacctgaaaacaattcaacatcagaaaatttactttcacaaaggaatccggaaaaaaagaaaagtatgaaaaccactgataggagttgacctaactactaaaaatctgtctaatgtttcttctcttgaagatattattgatgcaaaagcaaagtaaacaaaaatgaaactaaactctcactgcaaaatattctcataggttttttctttttttcccccacaaatatctcctattttgaacattctgcatgctttttttttttttcaatactgcatgcctggaatgtgtgtactgtagaatcaaacaagtttttcagatttgtctttaaaagctcgggggcaaatttttagaaaatatataatgtagaagaaacacaatgagaaaaaaatttcctgaagttaggctttcacatgaaagcttactaaggaatactactactcctaaacacgcagacagtcttcttgtattgccatttagatctatcattctgattgatcactgtgtagttggctattattgggcctaatttaaccctatacactcacacatccatctactctgtctattgtacctgacattctacaaattacttactcatgcaaatgacgacctaaggcaaccttttaggatattcgtgtttaattatacaaatggttcttgataaataagattatacatcgttccatatgtttattccctccttgatgaaaggaaatttaattttcatgcagatttggtggggacaatgtttaagaattgctgagttttttgtagtctgcagatccatccagtctgcagaagctgacaaaatcactccacttcccacacagagatgagcagttttttcattaggcttaaatcaacgtgctgcattctgaaatcctaaacggccccctttgtgttcacatggtcaaaggcaaaaggcaaaaaataaaaataaaaaaggaacagcctgctctccttgctctcctgtgtgattacaaggttgcaagatcaaagtttatctcttcctgttgtgtttagttgcttttggttgccaatttcgttttttttcctttcttttttttttttttttcccagccttagggtatcttgcttttgacagtcttgttgatttctctttggaggtctgggcagtgaattctgcaggaaaagcccccagtagctggacatggtgcagaaccgggccagccccaccagaaggtctcagagcccccacgttccatgtgatctcttctacccaagcagtggtcaacatcagtgcccctgggaagcccaacgggatcgtcagtctctacaggctgttctccagcagcgcccatggggctgagacagtggtgagcagcagagctaaaaatccaggactggttgacttttaaaaatcattactatgaaacctttgtttttatgtttttgtttttccctccatctttcttatccttctgttctcagttgctctacggtgaacttagtagcacaaatatccctcagagaagaaaaagtgaaccctgaggaaacatacagaaagtatgtaaactcttagggagagggatgctaaaggtggtattaaagactccacaaacgtaagaaactaagactttaaaggcaatcacactaatttaatttaatttaatttaattagaaaacagatcaaccacttagagtggtggcacatagtaagaagttggcaaatggtaattattggtggtgtaaatgttagtatgaaaacaaaatagagcaaagaatatccttggaatctctattttgacatgcacaaatctctaataatacatggaaaactctcattcctctggtgatttcaagaaagttctaaccctttagaagagagagcagagcagctccatcagcatagccctagctccactgtttgttcgttaacacgtttgaggcacactgggagacaggagagattgctcagggaaatcatctttcacattgtgcgttagccaagccacttcccggaagcgatgctaagaatcaactagaccagttcctgcattatttaaatgaagataccagcagccagcacgatgaagactcttgtctctgtggtatagcttgtgtcactctcaagtttctcatgaataagtggagattataatactttgttcacacaaacattgtatagagattgtgcagatcctggtattacactatgcattatttaggccaatttagggaacaatttgggcaagtgtggagaattcctctgagaccagagtgtcaggtattgaaacacaatttcaacagataacttacatacagggaggcttggattgaatgttaaaggaatattagcatattttctatagggcttcgtactcaataaatatagatgatgtaaatacaatcaacccttgattatccatgcttataaaatgataataaactaaaataatttatatttggagggcattgtatgcattttttaacagctcttcttaatcatatgttctttatgtcaacatgaacattaatttcagtttctgaactcttgttccgaagagtacttattaaaaccacaatgaggttaaaaatttgctcaaaataaaccaaaactttataatcctacaaagatgattgagagaagactatgatattttgtaaaaaccaacaccctcagaggaagagatagactttcaagccctccaatacttatacctgattttaatgtagatctgaaaagattttttgactgagaaattgcatgcaagtaaccatggcagaatatggaccttggtgaatgctgactagacatataattggaaggcagattttgttttttgaaaagacatcactctgagggtcatagactttgatcaacactttgtgtgttccgtgccattttctaatacctttctaaggtaatagataatcgataatattatgccttgtgatttccatcctgctacctcaaacgtctatttaacggttacattatcagatttttcacctatttgtcatacctctctaactgagttggtaattttttgaggataaatgtcatgctaaatgccatgttgtgtctcccagagtgcctggcatggtactccatttgtaggaggtgggatcttggataacattcatcaaacacctttaatgtttgacactgcctttatctagccttccttccttccacagctatccgaaggcatggccacccagcagactctccatggccttcaagccttcactaactactctattggagtagaggcctgcacctgcttcaactgttgcagcaaaggaccgacagctgaactgagaacccatcctgccccaccctcaggactgtcctctccacaaatcgggacgctggcctcaaggacggcctccttccggtggagtccccccatgttccccaatggtgtcattcacaggtaatgggtcaggcagaaggatgaagaaactaacaaggcatgtgtacagacatatgaactcatggtatagcctactctgcacctaggctacaaacctgtatagctacctggcactccccagggaggacttgcttattgaacagatatctatagcaaagtagacaaacaaattgatttgagtggtaatgttacctgcgatgtatttaaatcataaaagcaactaatgatagaaaggagaacaacgaaatgttttacattaaaaagacaatgcaatgtgttcgtattcaatatgctcttcctaatggttatctggaagcattccttctaccagccttcactggaacataagatacctccacagttaaatcagaattgccctgatctaatttaaaatattgtcataaaccactgtttgaaaggaaaaagaagacacttgactcaaaatcatttagaaaaaaaattatttactctaaaaagagaagaaccatttatgtctctcctcttaaaagagggaaatgtcttatctctaccaaaaaggatcactagttgctgggtaaacagcaatgtgtgtgtagatggtgacttctcttatcatttctctggttacatctgctgctcgtttccaatagcattacataaggtgtttctgagagcagtttcctgcaaatggaaattttaaagagcctgtagctctgtgaaaacaaaatgtctcctcacaaaatagaactggttttaaaagagagagttaaactaattccattacccgtcttgactctacgtatccattctcattttagctatgaactccaattccacgtggcttgccctcctgactcagccctcccctgtactcccagccaaatagaaacaaagtacacggggctggggcagaaagccagccttgggggtctccagccctacaccacatacaagctgagagtggtggcacacaacgaggtgggcagtacggcttccgagtggatcagtttcaccacccaaaaagaatgtgagtataagtggctgctaccataagccagagagattggaatgtggtcaggagaagcttgccctgaaactcggagaagccacttttaaaaacagattgagtgggctcaataacactgaatgttactgaagcattgatgaggatgactactgaggaaaaatgcctactggatttaataatatggaagtcaagggaaaatttaagaaggattttcttgtggggatagggtaaaaataaatttaggggaagttaaacgatcaatgggaagaaagaaaatgaacaaacactggtagaccatttttataagaagttttgctactccttttctttgtaaattacatggcataatctctagtatgtccagagagcattgagacatagcactattaggaaaagcaaaagggcaagtgagtgaaggaaagagcaatcaactaattaattgggggcttccttacatttttatataatacagtcacgcatcgcttaacgatggaaatatgttctgagaaatgcatcgttaggcgagtgtcgtgaaaatatcatagaatgtacttgcacagacctacatgttataacctactctgccccataggcatgtgactgtgctgaatactgcaggcaattgtaacacaatggttatttgtgtatctaaacatagaaaaggcacagaaaaaatctgatataaaagataagagggccaggcacagtggctcacgcctgtaatcccagcactttgggaggccaaggcgggtgaatcacctcaggtcaggagttcgagaccagcctgaccaacatggtgaaaccccatctctactaaaaatacaaaaattagccaggcatggtgacacatacctgtaatcccagctactcaggaggcttaagcaggagaatcactttaacccaggaggcagaggttgtagtgagccgagatcacgccactgtactccagcctgggcaacagagcaagactccttctcaaaaaaaaacaaaaaatgtaagagatggtacagggcagctccattataatcttatggaaccaccatcatttctgcagtcttgctcaaaatgtcattatgagatatatgactataacttagattttataaggtatatgctttcattgtttaataatggcaaacacaaaaagtattaagaataataagtgcttatcagaaccaactgcataatttatggagtccagtggaaaatgaaaatatggaatcctttgctgaaaaatctttaagaattccaagacagtaacagtacagcatcaggctaagtccaagactcttctatgtcacaggcccttgcaacagcacaggtcacatgccaaggaagctggtccagcttattataccccaacccagaggcaaccactactaatattttggcataatcaattcttttaatctcctttctatgggtaatttttactatatggctgaaatactataactaaaatttcatagtcagctttttatacttgacgttattgtatttgcatttcccgtggcattaaaaaaactctttagccaccaattttaatggctatacaatattccatatataaattaattgggacattttgttttttttttaatttcccattaataaatatgatgaaaaaatctttgtgaacagatctttgaatgtctggttatcttcttaaattaaattttgacaaatagaatttgctattaatacatcaagtattttaatattttaaggctttggatactagtttcatgtttgctttcaagaaagattatgtcagattataaatcttacctaaaatactctatctggcattgaatatgatgccaattttaaaagcaagaattacgcattcataaagaccaatgtctcacacaaggagcttaatgtgtctgagcaacaacatggtaggatgttagtaacagatcacatttacagaggacttgtttgttcctggcagtattttagcattttacaaataattcttacaacagacctattattatccaaatttacagatgaaaaaactgaggcagaactataaactgtgtactgcgattccaggatgccattcatatagactatgatctgaactgaggctcttggagttagacagtgacgtggccctaaactaaggccagagcttaagtaacctggccagtttccacatctagtaagtgcagtaattactctgaactcatggtcactgagctcagctgctgtctcagtactactctttccctgatcaattcatttcctactctctgtaatcaagacttcaaaccatctccaccttcgccaaacctccctctgccgctcaccctttctcccttcatgcccacaacccagctcacccatttctccctttattctctgcagaactccttgtcttgtaattttccaggaaaagagatgtcttcagtcagtaatttgctccacttcccactgcagacaaagctacctgcatataccccattgctgtcagtgacaaggaaagggtggtccttcttccgtctgaaataaacctgccttccatgcagtgaacttcatccacttcattactcaccatcccttctctctccttaatctttctgtgtatctcactttgattcaaagttccttctacccttctaatgttaaagcaaacaagctcctcttcccctgcagtgatgtggactctactctctctgacagcaaaactttcctgaggaacggtctgcagatgctttgcccatatcctctcttccacttactctttaacttcctcagcactggatgaaaatccctttctaagtttgcctttggcctccatactgatatatccagaaggcatgtttctccaggagtcaccttcactgactttccagtagcattcaacgcaactgaactttcaatgttcaatccttttttaaaaagtggtttaccctcattttcattaccaccctctcctggtttctcctctacttctttggattttcatttttagtcaactttgttggttgatcttcttccgctgcccaaatcttaatcctaaacattttaactttgtccccttgccgtttctctactccctcctttcctcctccctcatcaggtgagttcatctgctccaaggctttggttccaaaagccaaactccagtggtcacctcctagtcaagtgctctgttttgaagtgtatacccctccacccagattcctcacagacatctccctctgaatttctcataaccagcttacattggacaggccccagacagagcttgcaactttccccttcaagctatgcttcctttagtcctcactttctccattttcatctccagcactgggcacagtatcttagattccaatcaatgttgtttaatgaataagcgagtgcacctaacactgcatgtttattgttgacactgctcaatcagcattttttgtcacccatactatattcaaagcaaactgtaatgattcttaatgtgtgctgtctgattttgtaatctcctttgcactacatccagaagccaattttgctaaatgttgcagttttttggttgatgtggccagaaagccagagaacagctaggtgagctttgtaatttataaccaattcccttttgagtcatgaagcttagcttttgccagaattttttttttcttatgcttggaagaacaaagtgaactgatttaagattttcttcctgtggccaggcacactggctcacacttgtaatcccagcgctttgggaagccaatgggggaggattgcttgaggctaagagttcacgaccagcctgggcaacatatcaagacacctatctctacaaaaattttttttttaaatagccaggtatggtgacatgcgcctgtagtcccagctactcagaagactgaggcaggaggattgcttgagtcctggaagtcaaggctgcagtgagctgtgatcatgtcactgcactccaaccttggcaacagagcaagacttggtctttaagaaaaaaaaaaaaaggattttatctatttgtgtttttttatattggagaagcagcttaaacctggactagcaccataggagaagaggttcccttaatccactactgggtcaatagttacggaaaaatacaagaaatgactatgatacaggttctaaaataccacttatgctacttttaactcattataaatactgggagcacgaaaacatgcaccagagaatacaaaccagaaaataatttggggcctggtgtggtgtctcacgcctgtaatctcagcactttgggaggcagaggtgggcagatcacttgacgtcaggagtttgagacgagcctggccagcatggtgaaaccccatctctactaaaaatccaaaaaaattagctgagtgtggtggcacacacctgtaatctcagctacttgggaggccgagtagtgagaatcacttgaacctgggaggcggaggttgcagtgagccgagatagcgccactgcactctagcctgggcaacagagcaagagtccaactcaaaatagtaaccataataatttaaaaatagaatatgcagttttatatagatgtgatcacatgtacactcagcaacgggtctggagaagaagcctaacaacacatttagttccctctgcttgaatcccccttcagtggagagagaggtgaggtgtaaatgtttaacagctggcctgcttgagggaaaaatggcctgatttgaagtgcttatcagtttccatggtgtgaatacccccattactgctctcaagtgaccaacatgacagcactgaacagagttaggaagggatgggttgtagcgtatcattatataatatttccaccagccagatagagtggatgtaaatgacctcgagcacacagacggtagtaaaatgtagtgaaacaaataaaaagttatgaatttggagtatttataagctttgttttaatataatttatttaagtttatataatttaatttttagtagtggccggatttaacaatgactcacaaaattcctgaatatttaacagttggggtgagccaacttcagcacaccactggagagcacccatagggtgaattggtaaattctgttcttttcaacaaatgtgtaccgatgataacaaagtagcatgggccttatttaagcaagcctaggttcagctccttggtctcctaccagccactgacatagagcaagatatttgacctctctgaacctgagttttctcaccccaaaaattaggaatcaatctttacaggattattttgaggattaaatgagataaagtatgtcaaaagctaggagcgtagtggtacttacagctttttcagtcttccttggggaggatttgtaaactcattattctcgattattttaattgcttactctttttcctcaggaaggtctccaaaccctacaggacaaataagactcctatctttctattttcttgctagttacaagctgtttctttatctgtgctgttatgatatagggaaaaagtgaaaatctactgaactaaggtgatggagagaagtcatagacaaataacaatagagtattccttgtgatatcaggcagaatcaatgttggaaaagcattgagatttaaagagggcttgataactcttgttttggtgtttgcagaaaatttttcttatggctttatgaaaatatcttattttgaaagataacaatcaactgtgtctttacggttgaatattacaattacaaaagcataattattccttattttgttatatttcctaacatcagaaatagatggattgatttttaaagaaaaagaatcagattcaatttagtctcactactcactcctttcttttcttaaaagccaatttggtatataggtgaatcttaatgtttttacaaatatattgattattttgtagaaaataagatctcatgaaataaatctcttctgacttgacaagatgacatggtatcccttcatttgtttccacaaaaattattcatttaaaaggtgagccccagttaaggattttctttttgttttagtaaggaactgaaaaatcaagagaatgtgcctgtgaaatgcacacaaagttgcttctatatgtgatataatacttaggacacctgagcttgattatatactaatgtactatgctattgattgattagtcagggccatgaattattatacttgaattactgtttgcaaggctttttaactatcttagaaaacaaactaacagtttgagaaaaagctttaacaataaatgggtgccaaaaggacgtaattcaccatctaagcagtttggtttggagaaaaaaatatattaacttcatctagtccttggggctttgtggcaataaatattgatttgatatgaaaaatagctatctactgtacttaatagtattaaggatactttacctgttaaaaagagggaaaatgcaacaaaatatgagctccagggttatgctggtgagcagatccattgtatgttaatagttttatttataaaacaccactctctatcgattttttttaaagcaggcataaagttgctgagaaagcatttcacacatgttcccattggttttcttttcacccctgatactggttgtttcgtaatactgaggaaaaagtgaaggattctagcaatgttggttttcttttttttttttttttttgtttggattggttcggtttgattttgctcatattttttttttttaaagtgcacacctgcactccttcaaagaggttaccctttttagaacatacaactttctccccacagtgcctcagtaccgagccccattttcggtggacagcaatttgtctgtggtgtgtgtgaactggagtgacaccttcctcctgaacggccaactgaaggagtacgtgttaaccgacggagggcgacgcgtgtacagcggcttggacaccaccctctacataccgagaacggcggacaaaagttagtttctgactcctgtttctcagtgtggaaggcgctctgttccccagctttacgggatgctaaatctgaaagctgaccagcagatgctcaccattaaaatgtcttggtttaagtgcccccttcttgtgaaaaagttactgctcaggataaataaggttttctttccttcccatttgcagcttgacagcactgcagttataatgcagttcaaggggacagcgctgcctccacaggactggagggtccccaggaagggataagacccaagggccagttgggttcacaaaagaaatagcacccatacatagtcaatgactaccctaaaataatacacttctagcaacttcatagattttcttgctgtatctccagtctccaaacagagccctatcaggaaataactatctccaactcatgaggacctgaataaggggtttccttaaccttccttgatatcagcccctgaaagaacaatcttgaccctctaaaatggagttccttcttcctgtttacttacatgtcccttttctccttgccttgtttttaaattgaaatgagaaaatgctttacaaggtgctaagtattttatagtgatcagcatgctcacaggaccaatgttcactatataatgaattgattaatgagtattttattttggctgtaaggtagaggtaaacagtgagctccagcattgcatgtatagtaatagaaacttaataacatttttacaaagattcagctacacatgttcattgttacagttcatggtcacctgggcagctctttgggaaaggaaggtggcctgatggttgggagacacaggttctacctggccaggcctataaccatctgtgtgaccttgcaagggtcacttccctcaggttcctggccattggaagagcaatttagaccatgtgatttctaggatcccttttgagctctcctgttcagtaagaaactctaggtcatttagtggaaagtacacctgtaaattttaaaggaaggatttaaaccgtgtgcagaacaagatgcgctttgtgtattaccctttactcgtctgatgttcttttcctttgctgtataagctctaattttccttagctctattacttatggataggctattattacactaatgatagctttttttcttaaacattttaaaattagaagtaattttgaatattatataaaacgtcataacttgctttggaatcctatttttcatgctatgatgcattgctcttttaaaagcatgtgccctatttgtaggtgttgaatgaacaagtcatttaccagttcttccttttgtctagccttctttttccaggtcatctgcacgactgacgaaggaagtgttaagacgccgttgatccaatatgatacctctactggacttggtaaacaactcatattatacttggcgtagcacctattcatcttcctcaagaaacacacatatgtttgtttatacatacttggagtcctaatatattagcatagactatacagaagaaattgtgccaagtgttgtcagagtttttttttttgttttttttttgttgttgtttttttttgagacggagtcttgctctgtcactcaggctggagtgcagtggtgcaatcttggctcactgaaacctccacctcctgggttcaagcgattctcctgcctcagcctcccgagtagctgggattacaggcacgggccaccacacctggctaactttttgtatttttagtagagacatggtttcaccttgttagccaggctggtctggatctcctgacctcgtgatctgcctgccttggcctcccaaagtgctaggattacaggcatgagccactgtgcccagccagaaattttttaaaaagtcctcatggaacttatatcaggcaaggagttacaatacactctttttttttttttttttttgagacagagtcttactctgttgcccaggctggagtgcagtggtgcaatctcagctcactgcagcctctagctccaggttcaagcgattctcctgcctcagcctcctgagtagctgggactacaagtgtatgtcaccacgcctggctgattcttgtatttacagtagagatggggtttcactttgttggccagggaggtctcgaactcctgaccacaggtgatccacccaccttggcctcccaaagtgttggaattacaggcgtgagccactgcacctggccagaatgtactcttaaaatgccaaatattgaattgtaaatatggaaaagaccagagagctcaaactaaatttttctcctaaccacaaaccctgtcaataaagaattgtatgacttcgcgtgcataaaggtgatttacagaggaagttagaggagagatcagaagaagaaagaaaatattcagccaattcatgttgatcataatgttaatattctagattcaaagcctagaatgataaatttggaaagtgtcttttattctccataaaagattatgattgactgttgatatcgggtaatttagctcaacgggtacaattttaatttttaaggagcatcttttaaactgagttttactcatagtctctgaatctaaatttgtgatactttataaaagcaaattagagaaatgccaaatcttttccactaaaacagattcgggattgatatcctattttaaattccagtaattaatgatatatcaaatttgcatgtatagagtttttttttgaaaaataaacatgtccaaaatttctgaaacacaatttaaaaaaaaaattttttttaatttttttgagacagagtctcatacatgatgaaacatgtatattattgtcaaggatagtttcaatttgtaaaaataacgtattattctatgtttccaaactttacatgtctggatgtcatataaaatttcctacaacacttaattcttctcatacggcttatttcatttaatagcagtggtaggatagaacagatctcatttagtattctgttagcaactccaatatttccccaagtggacaagtggaggtataagggacacaggaatttatccaggaatgctctgctagcttgttactgggatgagaacaccaacacagattttctattgacttctggcctgggactttttctttgcaatggtttgccaagttaagtacgcataggaatcacctcatgtgcttgtttattgtagtttcccgggcctctggcagagattcagactcaaggaggctcagaatctgctctttaaataagtcctgtccagtgattctgacacagggctcagaaccacgtgttgagtgatgccggaaaaccaaggttgctcgccttctaagccctgccagtctagtttccttggtgaatgggaagtgtgttgttcctggaggcaggccatcaacagagacggatttactctgacactggctgtggtttcggttttctttggatctgaggcccagccaccagagtttcaaaccctgacagtgaacctcccatgtgatgcacaggtagagtcccttaaggtgaaggggtacttcaaaaagacagaagggaagggataaagggacaccatcctgatctcgaggtcttcataaaaaggagaaatcccccgttggctcatgaatacgaattgaggtttccactgtgtctggaggccgggctttgggtagagcagaggggaagaactctgaggattgtgcaatgctctggcagattccaagatgtgctgcccaactaatatccatcgtcagttctaattttcatgatgtaacttttttaaaaacattcctgttcccttgcctgaaggcagcctccaagcaggagagtggcagagacctcattttcctctgactgttctaagggctatttcccttttgaggcttccctcgggcaggctgccctcccttcccctgcgtgctgtggagcaaggggcccactgggcccatcagatcagtttctggagttacagccaacaagttgttttctctctgtgccacacacagaggaaacaactcttttagtgtgcaacctaggctggtttgtttttaatcaaacaacacacattggttcctaattaggggaatttcgacctgctggagcttgattggagtgttgactcaaccctttattttagagatgagaagcaaaggtcagagtccaacatttaatcacagagctgatcggcagcagagttagggttggcaaagtaatatccctcctcttacggagttcaaagtttagttttagtcaccatctgttcctgcctttaatagtttcaccccagttctgaacttttttcctttaagtctttccctgctagtgtgagtgtgaagtaccacgcaggcccatggagttctagaggtgttgaaaagggggagatttgtccagtgagtgagtgggctttgcagttgtgtctgcttgttcttctgacctggctgtgggtattagatttagatgagcagctctctggctcacatctccacaccagcctgtgtggccgctgcatcagatccacaggtttctgtgctggccccagcagtggctggatgggagcagatctctggccaccccacccccacccctgccgcacccctgcttagcttgccaagctgacaacataatttcactgccttcgcctatcctgcatgattcttgtcagcctctctcctatcttccccacaagacttaataaacctgcctggctgggtgcggcggctcatgcctgtaatcccagcatgttggaaggccgaggcaggcggatcatgaggtcgtgagattgagaccatcctggccaacatggtgaaaccccatctctactaaaaatacaaaaattagccaggcatagtggcgcacacctgtaatcccagctacttgggaggctgaggcaggagaatcacttgaacccaagaggcagaggttgcagtgagcggagatcacaccactgcactccaacctgggtgacagagcaagactccatctcaaaaaataaataaataaataaataaataaataaataaataaaaataatcctacccacccttcatccctgtaaagctctaagcataggacctggcaccaggtacattcttgttaaatgtgagctacttttattaatactaacttcatgtgcagagactcacaccaactgaactctcaatgtgtgaacgccaagcaaaggtaagtggctccagtgctaaaagatttctttccataggaagctttcccagtgcatttgggtgatggtttgctgagctttgctctttaacagagaggccatgtaaagacaacatggtagcaaacacaggctgttaatatcataatggaaaatggaatctgatgcttcaaaatccagtttgcacgaagtatcaggaattggactgttgcatgaagcaagtacacctcagatctccaaggagtgattttgtttgtgactctgcagcaataatagtaagggtcccagtccctcatgagaatccaagcaaggactttgctcccaagacacacagctatgaaacaggtgaccctcaaggttactttggtaacctcttttaaaaattgctccccacactcccatctttcccagggatttgtcaagacagtggtgatttccaacctgagcagcagcgccagaagtgtcagcaaggcctctcaagggctgtaagcatctcgttataacccagcaacctgctgaaccattaccccaggctgcacacaagtgcaaacaagcagtaagagacaaactgctttctgctttcaactcctctctaatttactatcaaatagcagggccagagatgacaaaaatgctttctgaaataacatttcccctttctttctctgggttttgcaggcttggtcctaacaactcctgggaaaaagaagggatcgcggagcaaaagcacagagttctacagcgagctgtggttcatagtgttaatggcgatgctgggcttgatcttgttggccatttttctgtccctgatactacaaagaaaaatccacaaagagccatatatcagagaaagacctcccttggtacctcttcagaagaggatgtctccattgaatgtttacccaccgggggaaaaccatatggtatgtttgtagaggtgtggccccatttccctatcactggactagaatacttgttttccttctgagaaaaatgtgtcatagccatggtaacaaggaattagatgtaagttatgtttcactaagtgtggggaccaagagaggctaaccctagaacagctttctcaactttggctgcacattagaatcacctggaaagctttaaaaaatatcactgcctggacttcatccgagaaattctcatatccttggtcttgagtagggcctgaagattggtattcttttcttcactccaaaactgattttaatgtgtaactagggatgagtatctctgccctgtaattgtaagccagggcctggtggagaagagttgtatgttgagattacctggggaaattataggttgtattactgtgtaatttggtggcggggaatgaacattaaaaggcggagatggggaggaaggggctacagtgctagtggtgctcggtctgtcctctggtcctgacaccctgtgccacagaggatggatggctcctcttagctatagaccactcactcccaaaataggaggtccagtaaaggtctagtgggagagggccccatcacttggtattacaggacagtcattgcccagagcactcattgaagggtaaaaggtgatttaattccatggtgcagtctggtgtggggctatgtctacctggaggaggaaaggctgcgttttctaatcctcatcaggtacccatctgttcaccaaagctgggcgcccacagggctacgtctccctgaggaggtgccttttttccagtttgcactaaggttctatattagctagtggctaccctaggcagtactaaaattaagcacagaagcctggtcaagctgcttacacttcaacatttaaaaaaacagcagtgagtgaacacagcagcaccatctgccttccagatctcttcacttttccagcactcagcaatgaatgaccactggttaagccccaacatagctggatcagacctaagtagcaggagtgttgggagcacaaaagggcagtgggccctccgaggtccacggtttgtggtttttgtgggaagtagcaatgggacaatgacgtggtggtggagaagcaaagaaggcactgcccaacaccatcagggccttggctctctactcacatctgtcccactcctctactcactcatcctcctcggagcctccttcctccctgagcccatcagacaagctctaaccacagggccattactgctgctgctccttgggtggctcacactcttgcttcattcacatctctgcacaaatgtcacctcccattctatgtaaaatttcctagccccttaacccacttcttttcttttctatagcatttaccacataacactaagtcagatatgtttgtctgactcctgaaatagaaggtaagctcccaggatcaatgatcttgtgggcctcttcctgttgtatgtgccccgggacccagaacggtgcctggcatatcataggcactccacgaatgtttgttgaatgaatgaatgtcgagtgatcacttcgaaccatgggctgtttgctcctgttcagtgaatagtcattaggagattctcactgaagagcagatatttcaaaatttttccttgttaaagaataactttctttaaggagcccatgttcctagaaggtgcactgctgctggaggaaggcagtggaagagagaaaagaaggcaggagagatctgtttagcctgggagatgagctaaactgaaactagggtctatggagtgcatggagtggtgaaagggaggttcccaagcactgctaggcacatctactgtataatgtgaggtgcggttacaggaaagtgtacccacataccagcaatgtccagaagtcatttcagtgatactttctcctgtcctttgacccagtccctataggcaggcacctctgtgtcagaatcctccatgaggaagaacactgtcttccttacttggttaacttagtgaccagaagacactcccatcattcttgtggagatgttatgttactctggatataaccccattgctcagggttttaatgagtcttgttaagcttcgttttgtcaaagtgaggaccatgaactatctgcatcagcatcacataggaggagcaggacctgaagttctgagggagaaactcaataatctgccattttaaccagaacctcaagaagtctgggccaggctcggtggctcacacctgtaatcccagcactttgggaggttgaggcaggagaatggtgtgaacccaggaggcagagcttgcagtgaaccgagatcacgccactgtactccagcctggacaacagagcgagactccgtcacaaaacaaaacaaaacaaaacaaaacaaaaaaagaagtctgatgcacagcaagatttgagaacagctgaaaatgaaataataatataatacaaaacctgtatgcagtgtactgtttgataaccagtagaaacaggtggtgggagggtgctggttagaccttgctgtcctgacaccacacaggctaagccgcctctggggacagacttaggcttcagctgagaaaagcggacaaaagaatgtaaacaccctgttcctgcacaccctttaccatcggggaaatgcacagtggcacccaactgattctttcactgagtggccaagactgagtcaggtgtgaggatgggaaggcatagagggactggctggctgccaggggctctgggcccagggaactggctcatcctcagcagggaagccattcattgcaggcaggtctcagcagaagtgaaatctgggatacaccagggcaccgggtggaattcccctgagcctgttgaatcataatttaatcctatccagttgacagtgtatttgcaagtcttcttctgttgctttttacaaatatttttaaaccaaactgctctcacaaagttggagaccatgagagacattgtcaaaaattagccaaactaaagagagtacaatttgtattagtagagcaaaatgaagtccctgttggtgactgtgggctcctcatctactcaggtgggaaagaatccagtcaaggggaagaatctgaataggaacaagccagattcacctgctcagttttccagattgactgtcttttcacttgagtaggtcaatgagctatgcccctgcaacacccacccacacacacacacacacacacttctccccctcatgtgacaagctctggtttcagtgctgctgtgaccctcttccaagcacccgtcttgtgaacaggtaagataccctttgaacatcagacccaaactggcaaaaggattttaggctatactctgaatggagagaaataggcagaggtgccaaggaatgagagtgtcttttgtatttcatcaacatttttcaagaccatacagtatacagtatagctaagtttaagttttgcttgttatttaattactggtttgaagatcctttcattccctgcaatactaaacaaatactggcagtggtacttaccttagacactaatcaattaatttccactcaccaaggtttttttttttttaatttgtttgtttttgagacagagtcttctgtcatccagactggagtgcagtggcatgatctcgactcactgcaacctccagctcctgggttcaagcgattctcctgcctcagcctcctgagtaactgggactacaggcgcccgccaccatgcctggctaatttttgtatttttagtagagacggggtttcaccatgttggccaggttggtctcgaactcctgacctcaaatgatccacccgtcttggcctcccaaattgctgggattacaggcatgagccaccgcacccggcctcactatgaagttttagttgcaaaacccaactttctctctctcatatatatatatatatatatatatatatatatatatatatatatacacacacacatacacatacatatatattcacatatatatgtatatatacacacacacatatatatacacacacatatatacatatgcaggtatgtatcctaggatatatatgtacatcagagcagtattaaatatgggtatgataatgctgtcattggagaaatgcaaggaatgtgtttaaaactgttccaaacatggactgatgctgccatttgttctcagtttgactctgtggctgatatatctgatgtgtcaagcaatgtcaccctaaaaagttacaccatgcactttgaggtacctctgtgtgctgcatgaatgcatgatcttttgcatggtgtgttgactgcacagtgaaaagcaggaacagatcattgatgacttccatatatccattccttggaaagctgaacaacatgagtgaaaactctactgaaaaaagaaaagaaatgggaggccgaggcgggcggatcacaaggtcaggagatcgagaccatcctggctaacacggtgaaaccccgtctctactaaaaataccaaaaattagccgggcatggtggcgggcgcctgtagtcccagctactcgggaggctgaggcaggagaatggcgtgaacccgggaggcggagcttgcagtgagccgagattgcaccactgcactccagcctgggcgaaagagcaaaactctgtctcaaaaaaaaaaaaaaaaaaaagaaaagaaaagaaaaagcagaaacatttcattgattggaccagctaaatcagagccctcagatatttagagcaactatagtttatcttacggcgcgttctaggtctaaattatgtagtgactttttctctctgatgttaatatcagacctgatgtaatttggaggctggaatcctataagaaatggaggaatatggaatgagaaatgagggagggaggagtcaatttccctacacaaatccaggacttttaaagtgaaagacaaacggagctcacatagtggaccaccatgaaataatattgttatctttggctgttctgggggaggagtgttctcaagagggaggctctgtgctgacatgtatgaagaagataccttgttcacccatcatccgtctgccttgccccaccactttgcaatgcagcaagcccttgccccacagggaacaacagccagagcaccagtgcatgagctctctaggtgccgaaaacactggccacctaacttgagtattagctcatcatctcatccttcttaccaagaaacccagggtcaccgtgttgtgggtgctcatagctgctaaattctgtaggtgacagttgttcccttcattgacaatgtgacaattgtcaggagacagtcattcccttcactgacaatgtgtgagacacaattctctgtcatatttcaagcccatattctttatatgtgaaatactcacagcaacttccttctcaggggttagccgataccaaaattccccggtctgggacacctgtgagtatccgcagcaaccggagtgcatgtgtcctgcgcatcccgagtcaaaaccaaaccagcctaacctactcccagggttctcttcaccgcagcgtcagccagctcatggacattcaagacaagaaagtcttgatggacaactcactgtgggaagccatcatgggccacaacagtggactggtgagttggtttcctcatacagggcctttgctaaatatcccagaaaaaatattggtacagagctgcctgtacttcaccgaatgctgccccatggcactcgcctctgagcacttagccagtgaggtagtaacaaccggtttactaatgttacttcagttgtttgataagcagggtagaaactttgtcttgttcttctggtatgcaatagatgcttaaaaataaatgcttattggctagccgtggtggctcatgcctgtaatcccagcacttggggaggccgaggtgggcggatcacctgaggacaggagtttgagaccagcctggccaacatggtgaaaccctgtctgtactaaaaatacaaaaattagccaggtgtggtggtgggcacctgtaatcccagctactaggggggctgaggcaggagaattgcttgaacccaggaggtggaggttgcagtgagccgagaccgcgccactgcactccagcctgggtgacagagactccatctcaaaataaataaataaataagcagcaaacaggttatacttcatatacttggagcagatgacaggaaacattggaatgggcctaaaacaaggcataaaatacaagcacttgttttactaaaacaaaaaggtactttttttgttttgccttttcctattggtgtatgggtagacgcaaaaagaatattttgtatcaacaggtgaacatggttgctttccaaaaccttaggaaatgatgacaaatgagggtgttactatttataagcttcatctttcataatttcagtccagtgggtacaaatcattggctctttgaaaggtaacctcttcgtgatataacatttattatcagtctctgagcggctacaataacaaaaatcctagaatttttgccaactatcaaatttcattgtgctaacttcctagatgcccgctgcagtacctaccattccactgggcctgttagaaaataaacagataggccaggcacagtggcttacgcctgtaatcccagcattttgggaggccgaggtgggcggatcacgaggtccagagttagatagagaccagcctgaccaacatggtgaaacctcgtctctaccaaaaatacaaaaattagctgggcgcggtggtgcgcacctgtaatcccagctactcaggaggctgaggcaggagaattgcttgaacctgggaggtggaagttgcagtgagctgagatggccccactgcactccagcctgggtgacagagcaagactctgaaaaaagaaaaaaaggaaaaaaggaaggaaggaaggaaggaaagaaggaaggaaggaaggaaagaaggaaggaaggaaggaaggaaggaaggaaggaaggaaggaaggaaggaaggaaggaaggaaggaaggaaggaaggaaggaaggaaggaaggaaggaaagaaggaagggagggagggagggagagaaagaaaagaaaagaaacataaccagctaggaagttagctcctgtgtttactcctctggggtaaaattattcacctccacttctttcaatcatctgcttctgtttttggatttgctctcatctttctcctccaagttctcacttttccttcactgaaaagttgatgacttccatgaagcctttcttgactaatagcaaataataaagggagttcgctggacccaggttccctaacactatataaaaaaatgtaccatccttctggcctgttcagaatgattgtataatatatacatatatataatatgcattttaaaatcacaggctgtttgatgttgttgtaacctcaactacatgagtccatttcagatctaaagtttttaaaaggcagggataattatatttggttgaaacaatgaattgctaactgatcatttttgacatgcaaaacagcaattgctatacattcaacataatacattgaaagttcagatgaattattacatctaatcttcacaaactgtaggaagtaggttctattatcatcctcattttttacaaaaagaactgaggtttagagagatgagtgatttaatgagagattacacagctagcaattatttttatgggtttgggttcttaaaaacatcatctgactacagagctcctatttgtaactattatactgtattgtcatttttgcttgctttttacggtactaataatgggcaatgtgcaaagggactcaataacaagcttttgaaggtgccagtacttggcaagttatctgtttattataacattataaccaacattactaaccctatttgataaatacaaaatacagcacaagagtgggaagaaatggagcacaaatagctagcattctgcctcttccatttaccgtttgaactaaatccatatatatgtgtgtatatatatgtatatatacagatcaccagaggtcaggagttcaagaccagactggccaacatggtgaaaccccatctctactaaaaatactatatacatacatacatacatacatatatatatatagtgtatatatacactaaaatatatagtatatatatgtagtgtctatatagtgtgtatatatatactaaaaatatatatatatacccccagctaatttatttttatcaagtatatatgtacacacacacacatcccactctacagatgagtagactgaggcttctgaggcttaggttaaaatatgacacaatataaccctcaaatcacatatacattttgaattagtctatagttcatgtgtgcatgtgatgtgatcctttcaataagagaaatttaaggcaaggtctgttttagaccccaccatggtgttgagaataaaaaagcctttaatacttattactttttacacttaattgatataactataaattgatagcaaatactattgatagcaagtatgtagccaatgatgattggcttatttttcagtatgtggatgaagaggacctgatgaacgccatcaaggatttcagctcagtgactaaggaacgcaccacattcacagacacccacctgtaaaggatggaaacccagaagacgtaaccctggaatgcaaggtctgcacccatttcctcctgggttatcactcacacatcataaatgctgaaaagccattgtttattatcctataattctttaaagaaatgatgactgtttttgaaagtgttccttcctaatagaggtctaagaaatgatatttttctcatcttaaatgagagagaatattcatatgaaaatacttgatttgctcttattttgtagaagacaaagaagtatgtaattgtcacttggttctgtttggcagtgatgctcctggttaactgaataatcagtggcaatttcaagatggctcacagttgttagaagtagtaagttagttactggctcaaaaatgattctgttgaaaggatgtcactgctgttcatttctatctgccatttctgtcagggttgacacaatcctgcaagaatagttattctaatgatcacagctgctaaatgaatcccaaactttgcaccaggtcgacaaacttttctgaaggttctatttatttaccatacatagggttacttaccaaactttttgacaaggctgaaggttctatttatttacaatacatagggttactcaccaaactttttgacaaggcaacacataacttacacataaatgtctctgttcttgcatttatgaattttccaaaaatctaaggagtaaacagcttatttatacattttgaggagaaaacaaagtgtttcactaggaacacctctacttgaaccaatgtttttatttcatatattttatagttttgaaactagtttctcataaaattctgtcaattcactgaatatcagagaatactgacatcttcaacctagcacatttcaaatggaaactactgttctatttgcaatattaggctgcgtgaaattttaaaaggaaaaatgtatctgttccttctagcattaacatatatacatgtagagacaagactatacctatgtgtatatatatgtatatcatgtatatattactctgcactatatcccttctttttggagaactagccattattttagccacagaatcagtaagaacagatgatatgcaacagtaccaattacggttcaaaaatgtctgtcacctgctctagttggattacaaagtcattggtgaaagtcctatggcaagaaaaattttcttgcaaatcatccacataaaatcagatatttaaatttgttcttcatggaaaacagagtaagaaaacctcttgtcttccttcatccttaaaggtctttgtgaccccaggaaaatattgactctgtctaacacacaatagtcacaatactttttgtgaatctacaaccagagacaggcaaaaacttgtaaagtaagggatagtcttacttattctgcctgaaaacaatgtattaccccagggcccaacagtaaaagattgtggactttttgggtattgagatttcatctagctctgtgagagagcagctcctcagactgaccaactcctagacaaagtttgccaaccataagtgtcaaaagcacaggccagtattaagcagaagttctaccaccttattagaactgctataaacaaaagcatctgaaataattgtgcacatctggcagtgactgtagaaaatacgaaatatatatttctcgccaagtttttatactttctgaaatgaaaacataggattgactagtttactggtttttattcccatatgccgattctgggacaataaagttgtttaaagctggcacaaataagcattaaccaaggctgtgtccaccttctgtgagctacttaaggtatataggaaaggagtggtcacaaacttgcatcctaatccttggtggactcttctaagaatacagtttgctagtcacaaagaatagtctacaaatatgctttgctaggttcagaagattgagtttatcctgatttttgaaaaattaaccaggtatctttatcactgtgtatttttccaagcacagtataaaattttaacaacgcacaaaaaaatacagaactgcaggggattttatcttggatcattatccatttaatcatctaattagacatgaactcagttagctgaatcatttacattttgactccatagcttagggcagacagaagcctgtatggcttctgcccagaactctgtcccctgctacatgtctaagtttacttgtatttatttcagagaagaactctaagatgttgctttgctactttaagtggtattgcgtgccaagcctctattatacaaaccatgcagactcgcctctagagattctgattcggttgatctggggtgtgtggctgaggcatcagtactttttaaagcttccaggtgttctaatgttgagacccactgatgttccacaatctggaagaaatcatgtacaggaataatatgctatgcacagggactatgctccttggctcaccccttctcccttataaacaatgagcagttcttgatgaacctctttaaatttaaatctcctgactcacattttaccaattgtacatgccacattctcagcttacgaactaccatgttttgttattcttaatatcaactgtttggtaagagtacagttgtttttatacactctaagaaatgtgtttataatctactgtaatttccactaaatggaacccaaatattaatgttatggtaccatatactgatgtaaaaatcatgctggcatccatgaacacaccggtaaataaaacatagtccaagtggaagaattcattaataaggaacttttaattatgtcacaaatgaatagttggtttccaatgcacaaatatcatgtaaactaatctaaagatggtttgcttaataaatatttgaatgtgacc

SEQ ID NO: 10 - DNA, 23 bp, Artificial
  antisense oligonucleotide
gtgtgattctggagaggaagctg

SEQ ID NO: 11 - DNA, 20 bp, Artificial
  antisense oligonucleotide
cccttaaaagccagcataca

SEQ ID NO: 12 - DNA, 192 bp, Homo sapiens
gctaattaagctgctttcagcttcctctccagaatcacacaagttaaaggacccttctgcaacaagagcagcgaatctactcagccagagcaggaagctaataaaatgtatgctggcttttaagggggaaacaaatcatgaaattgaaattgaacacctctcctttcccaaggtaagagatcatctttaaga

SEQ ID NO: 13 - DNA, 850 bp, Homo sapiens
ttgtgagaaaacactcaatattttgtgttcgtatcatctgcagtagcattgtttgtgtctcgtctatcttgaatgaaatcattttcccatcctcaccttttaaatatattttatctttagggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtaagaaagaaatgtattacattttcagtgcacaatgacattccttttgttaacttaggtaacttctccctgtttctggtttgtggct

SEQ ID NO: 14 - DNA, 300 bp, Homo sapiens
attattgtcctaaattgacaggtgaagtatgctgtccagatgaacagcacaatcgggtttctgttggcattggtgattcctgctgtggcagaatgccgtactccacctcaggaaaccagatttgctgtgctgggaggcttcatgatggccatggccagaagtgctgtggcagacagattgtgagcaacgatttagagtgttgtggtggagaagaaggagtggtgtacaatcgccttccaggtaaggggcccaggtctacctttcagtagatggaggatctgagaagcagagagagtgaga

SEQ ID NO: 15 - DNA, 24 bp, Artificial
  antisense oligonucleotide
gagccatggaggttacactggcag

SEQ ID NO: 16 - DNA, 22 bp, Artificial
  antisense oligonucleotide
acacaggcactggccactgatt

SEQ ID NO: 17 - DNA, 24 bp, Artificial
  antisense oligonucleotide
gtgctgttcatctggacagcatac

SEQ ID NO: 18 - DNA, 23 bp, Artificial
  antisense oligonucleotide
agtacggcattctgccacagcag

SEQ ID NO: 19 - DNA, 43 bp, Homo sapiens
aagctgctttcagcttcctctccagaatcacacaagttaaagg

SEQ ID NO: 20 - DNA, 40 bp, Homo sapiens
gctaataaaatgtatgctggcttttaagggggaaacaaat

SEQ ID NO: 21 - DNA, 44 bp, Homo sapiens
gatgtgagccctgccagtgtaacctccatggctcagtgaacaaa

SEQ ID NO: 22 - DNA, 42 bp, Homo sapiens
tttgtgacccaatcagtggccagtgcctgtgtgtgcctaatc

SEQ ID NO: 23 - DNA, 44 bp, Homo sapiens
gacaggtgaagtatgctgtccagatgaacagcacaatcgggttt

SEQ ID NO: 24 - DNA, 43 bp, Homo sapiens
ttggtgattcctgctgtggcagaatgccgtactccacctcagg

SEQ ID NO: 25 - DNA, 20 bp, Artificial
  sense oligonucleotide
tgtatgctggcttttaaggg

SEQ ID NO: 26 - DNA, 33 bp, Homo sapiens
gctttcagcttcctctccagaatcacacaagtt

SEQ ID NO: 27 - DNA, 30 bp, Homo sapiens
taaaatgtatgctggcttttaagggggaaa

SEQ ID NO: 28 - DNA, 34 bp, Homo sapiens
gagccctgccagtgtaacctccatggctcagtga

SEQ ID NO: 29 - DNA, 32 bp, Homo sapiens
gacccaatcagtggccagtgcctgtgtgtgcc

SEQ ID NO: 30 - DNA, 34 bp, Homo sapiens
gtgaagtatgctgtccagatgaacagcacaatcg

SEQ ID NO: 31 - DNA, 33 bp, Homo sapiens
gattcctgctgtggcagaatgccgtactccacc

SEQ ID NO: 32 - DNA, 642 bp, Homo sapiens
ggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccag

SEQ ID NO: 33 - DNA, 219 bp, Homo sapiens
gtgaagtatgctgtccagatgaacagcacaatcgggtttctgttggcattggtgattcctgctgtggcagaatgccgtactccacctcaggaaaccagatttgctgtgctgggaggcttcatgatggccatggccagaagtgctgtggcagacagattgtgagcaacgatttagagtgttgtggtggagaagaaggagtggtgtacaatcgccttccag

SEQ ID NO: 34 - DNA, 20 bp, Artificial
  PCR primer
cggaggtcaacaacgagtct

SEQ ID NO: 35 - DNA, 20 bp, Artificial
  PCR primer
aggtgtaggggatgggagac

SEQ ID NO: 36 - DNA, 20 bp, Artificial
  PCR primer
aagttggtgcagatccttcg

SEQ ID NO: 37 - DNA, 20 bp, Artificial
  PCR primer
agaaacactggcctgtgacc

SEQ ID NO: 38 - DNA, 42826 bp, Homo sapiens
gaaggaactgtgagctgtgcaaggattactttttccgacaagttggtgcagatccttcggccatagatgtttgcaaaccctgtgactgtgatacagttggcactagaaatggtagcattctttgtgatcaggtgagtttttctgagtatttaaggtaaaggattactctgtctgccagaaacttatttggatgttattccactagtagaattgaagactgcatttgccaggaaatcctctatgtgcatttgcatttcaaagagatggttgttcgtgtgcaactttgagtatggacatgaaatatagcactagttcggtggtcctttgcatataaaaaggcttattttagttttaattttacaaatgtcaaaaaatcgaagggtaggggttctaagtaaattggggtatatgtcttggaattattggtgaattaatattaatacatgatataaataaacaagaatagtttctccaaaaattccatagaagatcatatagcaaaagtcacttacacttagggccaaatggaaattatgatagcctcgcttctcaatttcttagtctaactttccctcttaaaagtacaatggattttttataattttaaaactttctgtttacttacatcacaaatatcgatgtctagcctacatgcacacagattctaactaacctcagttcatgtatcctacctcaagcaggaaaacaggcttcttattgaagctgaagtttttcctgttctgataatactaataagtgaaaattgtgaaaatcggtaaaggagaaatttactttgaagaatcaattcaatgattgtattaattttaaacagttatatactctgttatgaataaataaggctaggagcataaaccacaatccagttatagaatatttgttaaaaagttatattgtgaacataatacacacaagacaaaatatctttctcctataattttgagaattcattaaaaattgctttcccaaataaaagacaaatataaaccaagacaaaatatggattcaaagaccttcagagtaaccatcatgtgtcaataagggggcattacatgcttcattagaaagctgaagagtagaaaaattattaataaagacaatttctactatttttattttataatattgagggactattttctcagaaagtcatactacagttttccatatattaattagtaaactctgactgtatctttagattatatttcatttttacacatccaccctgagttttcagcatggctatcttttgcttatcattcaaatattgatatatcatattttgagatatctttgctgaccacccaattacaaaacattctcaagtctttcatatcaccatgttactctcattacaggctctgtaaaattaatttatttgtttacttttcttcttctctctttccaacataaacagaacagtttcgatcatataaaaagcccccaataagtatttgtcacataaatgttgaatgaataaagagagattatctgagcactgatcttatagttagattgttattttaaacggtcattacaataatctgagcattatgtaaattttcacttgcagaacagtttttctccctgaaaatctaaggtcaagagctttgttatatagtataggaagactgtaaactatagttttacctcccagaatctcagttacgtgtctaacctacacgagttacagtgcatcagatttgtctctccatttcaccattcagatctacaagaaattgaaacctgatttttctgaactcaaacttctatttcaagtccgttttatagggatgctagacaaccttgggtggttctgtgcttgtaaataattaacaactgactaagaaaaaaaaaaggccaccataatcaatttcaatctaccagtgagatgtcactgaacatggatttcagaagaaatgtacttaatctgctcttatgagccagtgcagtgtactccagcatactactggctctagatttctttcttaacatcttataaagtggagctaattattggatggaattatgaaagactgtaccatttataagcaggatattagctgtagatagtgttattttttaagttggagaaatttttctctattcctagtttttctgagagtggtttttatgaatggtgttgaattttgtcagctgctatttctgcatcaattattatgatcatgtgatctttttttctttagtttgttagtgaagtagaatacattggttgcctttcaaatgttgaaccagcattgcatccctggaataaaaccacctttgtgtgtgtctttgtgtgtaattcttttcatatattgttaaattttatttgctaaaattttgctaaggattttacatctgtattcataagaaatattgctctatggttttgtttttataaattgtgtttgtttcattttgttattaggataatactctcgtaaaatgaattataaaatcttccttcctgttgtttttctataagaaatgcagaactggtgttaattactctttaaagtttaccccattctaatacatagtattctagtaaatacagtaccccatgtattagtccatttttgtactgctgggaagaaatacccaagacagagtaagttgtaaagaaaaataggtttttatttatttatttatttatttatttagagacagagtctcgctctgtcacccaggctggagtgcagtggctcaatcttggctcactgccacctccacctctggggttcaagctattctcctgcctcggcctcctgaacagctaggattgcagatgctcaccaccatgcctggctaatttttttcttttttttgtatttttagtagagacagagtttcaccatgttggctagactggtgtcaaatcccacccacctcagcctcccaaagtgctaggattacaggcatgagccaccacacctggccagaagaatagatttaatggacttacaattctacgtggctgggaaggcctcacaatcatggctgaaagcaaaggagaagcaaaggcatgtcttacatggcagcaggcaagagagaagtgccgagtgaggaacagggaaagccccttttgaaaccatcagatttcatgagaactaattcactatcattagaacagaatgggggaaactgcccccatgattcaattatctccacctggttcctcccacaacacatggggattatgggaactacaattcaagatgagatttgggttgggacacagccaaactcacacttggcccctcccaaatctcatgttctcaccattcaaaacaaaatcatgcccttccaagagtcccccacagtgttaactcattccagcattaactcaaaagttcaagtccaaagtctcatctgaggcaaggcatgtcccttctgcctacaagcctgtaaaagcaaaagcaagttagttacttcctagatacaatagcggtacaggcaatgggtaactacacacattccaaataggagaaattggccaaagcaaagggcctacagtccccatgcaagtctgaaacccaatggggcagtcattaaacctcaaagttaccaaatgatctcctttgactccatatcttacatccagggcatgctgatgcaagaggtagctcccacagccttgggcagctcggcccctgtggctttgctgggtacagccctccttctggctcctttcacaggctggcattgagtgtctgtggcttttccaggcacacgatgcaaggtgttggtggatctaccattctgaggtctggaggatggtggcccccttctcacagattcaccaggcagtaccccagtggggactctgtgtggggggtctgaccccacatttcccttccacactaccttagcagaggtacttcattcattagggctctgcccctgcagcacatcctctgcctggacatccaggcatttccatacatcctctgaaagctaggcggaagttcccaaacctcaattcttgtcttctgcacacctgcaggcccaacaccatgtggaagctgccaaggcttggagctgccattctctgatgcaatagtctgagctgtatgttgatcccttttagccatagctggagcagttgggacacggcaccaagtccctagactgcacacagtgggggggccctgggcccatgggaccattttttcctcctaggcctccaggcctgtgatgggaggggtgatgagacatgtcctggagacactttcccccattgtcttggtgattaacatttggcttcttgttagttatgcaaatttctgcagccaacttgaatttctctccggaaaatgtgttttgcttttctactgcattgtcagcctgcaaatttttcaaacttttatgctctgcttcctctttaacacttactacttagacatttcttccactagataccctaaatcatctctttcaagttcaaagctctgcagatctccaggggaggggcaaaatgccaccagcctctttgcatagcaagaatgacctttactccagttccccacaagttacttatctccagctgagaccacctcagcctggcctttattgtccatatcactatcagcattttggtcaaagccattcaacaagtctccaggaagttccaaactttcccacatctttctgtcttctgagccctccaatctctttcaaactttcccacattttcctaccttcttctgagccctcccaactgttccagcctctgcctgttacccagtcccaaagttgcttccacttttttgggtgtctttacagcagcgccccactacccagtactgatttattgtattagtccattctcactcaactataagaacaaacctgagactgggtaatttataaaggaaggatgttaattgacttatagttcctcagggcgggggaggcctcagtaaacttacaatcatggcagaaggggaaacaaacacatccttcttcacatggtgacagcaaggagaagtgccaagtgagggtgggggaaagttccttataaaaccatcagatcatgtgagaactcactatcagaagaataggatgggagaaactgcccctcatgattcaattatctccacctggttcctcccatgacatggggattatgggaactacaattcaagatgagatttgggtggggacacagcgaacacatattgctccagtaaaactatctcagatttctttggaaacagaaataatttattattaattcaaaattaaatactacatatatatgtacatatatgtgtgtatatatgtatatatatagagagagaaagacagagagagagatacaaggaaatgagagtcatattaacatcattaggaatttaatattactagaagacagttcagaataaccttaaaatcccaaaagaagacattttgaagaaaaacttgatactcagttctatccaagctatggcaccaacatgaggttaagattctttttgtacgagagatggtcaaaacattaccattcataaccccatattaaaatattcaatatgcaaagtgaaaaaggaatgtaagactggggacaacattaaacaaaggaaatgacaaacaattatgatccaaagaaataaatacataagtcaaaaaatattttcaaagtatccattggtctttatggtctgcaaggatagtttccttacatacatgtttagtaattcaattttatttaagatcaaatcacaattttttgtgatttgagataaacaaataacaagtagagggctaaaaatactatatccaaatatttcagtgagaaactggatgcttttttcctaagatcaaaagcaagataacaatatcccataacattgtactgaaagttgtagccaagaaaatgaaataaaagacattgagactggaaaaagagaagttatttgtatttgcatatgccattatcttatagatagaaaatcctaaggaattaattcaaaagtattaaaactaataaattcaggctgggcgcggtggctcatgcctgtaatcccagcactttgggaagccgaggcgggtggatcacgaggtcagcagatggagaccatcctggctaacatggtgaaaccccatctctattacaaatacaaaaacaaaattagctgggcatggtggtgggtgcctgtagtcccagctactggggaggctgaggtgggagaatggtgtgaacctgggaggtggagcttgcagtgagctgagatcatgccactgcactccagcctgggcgacagaacgagactacatctaacaacaacaacagaaaaaaacctaataaattcagcaaggttgcagagtacaatatcaatacacaaagatcaattatatttccatatatttgcactgaacaatctgaaaataaaattaagaaaacgtcttttaaaaatcaccaaaagattaaaatatttagaaaaacatttagtaaaagaagtgtaaaattatattctgaaaaccataaaacattgctgaaataaagaagaactaaataaatagaatgacacccaatgctcatgtatcagaagacttaatattattaaattaacaacactctccaattgatctacagatttagtgtaatctttgttaaatgcccaccttacttctttgcagacattgaccatatgatcctaaagtttgtatgaaattcatgggactcaaaaatgtccaagataaccttataaaaaaagagttggaaaactcacccttcccaatttcaaaatttactataatcaagacagcatggtactgggataaagatagacatagagacatattcactgaaatagaattgagaatttacaaataagccctcatatttatagtcaattgatttttgacaacagtgccaagacagttcagtggagaaagtgtagtcgttttaacaaatggtcctgggacaattgtgtttttatatgcaaaagaatgaacttggactcctaccccacctcacatataaacaaattaattcaaattaaacaaaatattgaatataaaagctaaaattataaaatcttgagaagaaaatgtagatgcaaatcttcatgtcctcggattagccagtggctttttagatatgacaccaaacgcctaagaaacagaagataaaatgtgtaagttggacttcattagaattaatatttcaaagcacaccaacaagaaagtgaaataaacaacccaaagaattagttgcaaagtatataataaatctgtaataatgaagaaaatatttgcacagcatatatctgataagaagcttgtctagtatatatgaagaacttgaagtgaataatcaaaagacaaataactcaattttaaaatgcgcaaataatctgaatagatatttctctaaggaagatataaaattaccagcaagcacataaaaagatttttgacattagtcatcagggaaatgcaaatcaaaactactgtgcaagcccacttcccaaccagtgggatgactgcaactcaaaaaaaaaaaaaaaaaaaaaacagacaaaaacaaaatttggtgaggatgtggagaaattggagtcttctcataggctgcctgtgagaatgtaaaatgtgcaccgactttggaaaatggcttagtgtttctcaaaatattaaagatggaattaccatataacccagaagtttcactcctctgtatgtatcatatatcctcataaaatcttattggtgaatgtcaatgccacattgtttgtaatagtcagaatgtccatcaactgctgaatgaatagataaaatgtagtataatcacacaatggaatattattttacattaaaaagaaagaaattactggtacctgctacaaaatgtgctcaagtctcagaaattagagtagggaaaggaagacggacgaagaatagagaaagcttgttttgttttgtttccaagtgcaaaaatctgttttaaaaatatatggaaggaaagacatgctttaaaatgttaacttttttggttttaaaaacatttttccttttatataaacttttttctctttccaaatctgctttatttataacttttatagtcagaaaaaaaggagaattttcattcaacctgatatatagccagagagaattacacataagaataggaatgtaaataagaatgatagaactgttttctgactttaaacccccacattgtttatctttaaatcacattcatatattatcttaatttttattattttctcatgctccaagtatagagacaaagtttatggagtatcgttacatgtggagatattgtgtcaagtctaccttacctaaataatgttataaaagatttcaaaaaatgtttccagacattgtcaataggataacagaacacacacttaaaaagttgtcaacagtgtcagaattataaactgcaaaattgaattcaaggacatttaaaaaattcatgcaatttcaatccttaataatattagggagcacacaaggaaattaggcagtagttcaagtctcattttgttataataacttaggaatgaagccagccccaaatggcctgagtgactgtgtcgtgcgctctatgttctggaagggaactttccctttggcacttgtcatttgaaactcaatccaatctcataagatatggcatgtttgccttattcttccataagaaatgttgtaattcttccttatgtgaatgccaaaatcttgagaggggcataaagtaatgctctgagtcactgaatcctaaaaatactgatgccacagtcaagacagagagaacatctaaagcacagtactaatattaataggagagaggaaaatgaagagtaataatgattattgaggaataactaacatggaatccttggatcccttgggttactatatgagtgtatattttatgtctgtataaattgagtaggatacaatttatgtctgtgtcatacaactgtaagtctgtgtatttttccttttttttttcttttgtctgtatttttgagggtgagagctttcagtactttcatcagatccaaaagggatacatgaaccaaaaaagatgataattatttcaccatggaaaagaagtctatcttatgaacaggctgggttattagttcaggtacatattatgtgagtttttcaggataccactgcacttccttcttgtttgcttgaacttaatgcatgaattacttgacatgcatcctgagttggaggttaactgtccttttccatttcctcatctagtgtgacttaagttcagatcaatcaaatagagtcccaggcctagatgatgcctcttctgtactttgacatatctggagaagggtctgtgaatccacacctaaagtgcatacatctagagatctcagtctgatcctgacccaaggtgggagtgagccgcttgtctccatcctttccctccactgaccccactcctccacatattttctggtagccccagagtccctgctatagccacctccacaggtgatggtgataaggtagggagaccggtgaaagtccctaacataagtccctagcatatggcctgactcatgtagaatgcattcaagaaatattgtctgagtgctttcttgcttgggacttttttcatccctgctaccttctctcccgtttactttgcttgttattgggttgagctgaggaagccatgggggttcagccactgtagtcaagatggtggtcatcagctagggtagtcctcaaacttttaatgcacatgtgactatcctaggtatctttttaaaagacagattctcattcaggaagtttggggttggggctcagattttacatgtgtaaaagttcccagatgatacaattgccgcctgtctgtgaaccactttttgataaccaaggagttagaacactgtatatcaaagatatgtagaccaaagaagctgaatgtagatgggggtaggggagttgtgagtgtgtactcacgagcacatgtatactcttggtcagttgtgggtttactttgctccatcctctgaatcccatcttaaaagcaaggattttccaagtcatccaaattaagttaggcttgaattgtgccctgggctctacctttaaaattagagtatatcacctaatagccatttttaaaaggaaataaaaacaacaaataagggaattaaaaagttgtgtgaaaaccaaaaatatagttgtaattatataaaaagagagaatagcagattgtaatgctcaataaagcatcaataggttactgtaatagcaacagaacagaaataaatgattaagagatatttaaaaatagattaataagaaaggaaactgaggttgaaatgaattagacgaaatggaaaggcatcagtgaaagaagcatttctaggtctgacctatggaagatggaataataaggaacagagaccctactcatgaaaattgattgttctggtgaagtgataattttcaaaacaatacatttaaaatttgaacagaatatactttctctgcataatgtaccatttttctgcagttcattaatggtttctcttctgttcagaattaggtatttgtcattaattaccataacatgtccaaaagtcatcaggtgaacttccctgaagtatattcttatattttgtatgactcaaatattaaagtgtacaaatagaaaaaataagtattgcataagtttccttagcttatgagaaacctgaccatgaatagtatgatccatggatattggatgtatacattgaggtggtgaaggatgtgaaaagaggagagttttcccagagcttcaatagagacagaaaggtcttggcacaagccacgtggtctctccttcagagaattagggaagtttagtagtaatatttctcatagagctggtaaattgagtaatatctcattattctgagattgtagaggatgagattcacaaagacaggaacaaaggtcctggggtataaatgggaaaagaagggaaaaattaatcttagctggataggaaggttagtattgagggagttatccaagaatcaaggttgtgacaaactgcctgaaagtaaaaatagatggagttgtaactgagatgaggtcttagcctccagtttatgttgagttccacatgtttgaatacatctgacatctttttgggaacaagctcatcacaagggcccaggtatacaaaattggccaaataccaatacctcaggcatttaaggctagattcaatagccctaaatagccataatagcactagcagaagcattaggtagtgtctggatattggaagaactgatttaactagtaagtgcaagataatgtgatacaaggcccattgccttgctaccaatagcaatgtagttagaataggctaaacagatgtaacaaacccccaaatatctagtggccaaaacaatatacaggctcatttgttgctcatataacctctccaagacagctgttcctacctccttgttggatcttctctttgtgacaattcagggacacatgctccttccattgcctggatatgcctttaactagggaaggaaaagacaatgtggaaaacaacttccacttttaaaatgctttggtccaaaagaggtgtgtgtcgcttctgctatcattgccattgatgatagctagtcacattgctaactagttatatagaaggctgaagacatgtagtctctagctgggtaaccactttgcagctacatttgtgtactattgaagactagggagaatgagtcttgatggggagcatgtcatctctgcttaatactcatgcaacagaaggtagcccaagagcgaaaggggcattctcttcttttctacacacagaacaggataacttctgtttaatgaggacctctgagaatagagtaccccatgagcatctcaggggtgccaagccattaatattggtgggactacctgcttggaggtggaccctgtaatattggtagatgcacctgtgaaagcacatatcatagcagcatgtatcagcaagagagaattggacataggaggagaaacagcttgtgtgcaaggttaaaagatttgttcatgagcacatgtgagagagaagccccaggaacaaggaaatgagaaaacaattactgcctcctacatgttcccagaggagggggctgggagagcaattaagcataaagagcattaattgcatagaagatgctgagggatcatagatttgaaagcaatttcaaaatatgagtattttaagacttttagcaagaacagacaccataggctgtatatagtttcctggagttatgattaaaggatgaaaacaacttttgtttagatatgtaggtaggtaagtaggtagatatagatagatatgagaatagtaagtttgtttaaacaaattattcattacatcatagtgacccttagtgctttttgatgatactgactgatatggtttggctgtgtccctacccaaatctcatctaatagctcccataattcccacgtgttgtgggagcaacctggtgggagatgattgaatcatgggggcaggtctttcctgtgctgttcttgtgataatgaatgagtctcatgagatctgatggttttaaaaatgggagtttacctgcacaagctttctctgcctgctgccatccatgtaagaggtgacttgctcctccttgccttctgccatgattgtgaggcctccccagccatatggaactgtaagtccaacaaacccccttcttttgtaaattgcccagtctcaggtatgtctttatcaccagcgtgaaaacagacgagtacactggcttattgaggaacagaatataatcagcctccttcattcctcactcactaaaccaatgtgctgatcatttctagaggcaaggacactccaagaatcaagaaagagccgatgatgaggctttctattattctcctggactggacgttgtctcagcttctgctgggccatagaaccctgcctctaccttgacttacccacatgttgttttggtgccaagtattgagtgctgcattttggggtgtacaagacagattggcatattgctaaaaatgtgcgaggacagaaatgacagaaactagtctgtaagattctcataggttccacttgtcttgcactcgtcatgtacaaaaatatgccaagcattgtagttcattaattcagtccttaccaaagctggtaaagcagttattaatttatccactgtaaagttgaggacatccagccttttggaaattaaataactcctccaatatcacacaagtaataaggaggttgtgcagaaattgaaaacttgtgaatttccaaagctcatgcccagctggaggttagagacatagggttcctaccaaaaatgtgttcctagcactcagcatagtgttcagcacttaagaggaaacctacagcagattgctaaactgggtatttacttacactatccaaaagtaggaaggaaacatacccatttgtttgtgaattattgtatcaaatcctattaatttcatcctaaatattaaataaaattcctaaataggaaatagcaatgttcatataaagaagcagcaaattaatttattggaatcgacacattcctcaaatggagatttggttgatattagagacttaatgtacctcccttagtgcttaatgtataacagagattccacttatcttacctatataacctaagaaatttgaatattttataaagttactttttagaaaacctgatttatttgttttccttgtcatctcagatggataccttcctctcaaaatctatttggaatttatattttcaagtattcaattaactaacatattaagcaggcattctcctgtgtaagttcctagcaacttttaccacttgtactaaaataaaacagatagttaagccaaatgagttaacttttctgaaagtgtatctttatacaacattaactatagacatggaaaatacatttattcacgttagaaataaatgcttctgtgagatctttcattttgataaagtcaaaacaccatcttattaataactactatattaattttgcagcaaattacaataagaccacactgtatagttgtgccattcagatgacatttatgaaatgctctaatttaacatggtgacatatattacctgcatcttttacacattatagcttatatcctctgagcgaaatagacctaaaccatccaaaaaaaaagagagagagagagagaataatgcaatgggaaattatacccctttgagaactagaaggactataattacattgcttcctcttaaaaccattcaaatatgtaaccattgctgggaacagcagtatgtggggaacctctttacactctttctgtcttgaacactcaaaagattgagaaaaaaatattcctttcctactatagttttatttgagcatgcttcagaattttacctttttgcacactccttagagattatcgtggggaagtttagaaagcagtttcttggaaatgccttttggaggggaagaggagctataaaaatataccagcctgacaaatgacaggcattgtagactggaaaagaaaagacatcttggttttacaccaatgtagaagcttttctttgcaaatgagtatttttgacagctgagcaagatgataaacagaagtatcacaaaacacttaaatggaaacaagtattatgatgtactttattcacctggcattctccaattcatgacatttatatgtggcagaacccactgcagattcatttatttatttttgaagtggaatgagttccttacgaaggtagcctgttacattaatgtggacttttcttctctagatgcagaagcttaaggaaaaaagttattgtatctgtactataaataagtggtaagtctcagaatccacatcttagggctgagaaggctcctagcaagtacaatatactgtataaatatagacaaataaatatagatatagattttttgtgtaagcaccggcagtgttgcaaatgattagatatttcataaatgccttttctaaaaaggtattgctgaaaccagtctatttctagaacttatattcagatgtttagaggtataaatgcttcaatattggctaagcttagaaaggctatgtttctctgaggctcagtgatagacataccaacaatttgatgagatgcatgactaagaagaaaaagagagtaagactgagtccctgtgaattgattgacttggtgcagtggcagagtaggtagcaagtattaaagcaatagttcttaaatgttagtgttcataagaatcatcaacagaactttttaaaaatgaagattcctaggttttaactttagcgacttttaattctttaggtctggtatatttggttgtgggaaatcaaaagactcaacttcggaatacactgaacagttgctgactatagatttgtatattcaaaattttttggtatttaaaaatggtatgtatggtttattgagtcaaatattttaaaaactatgaatgtgtgctggtttgtttttttttttttttctggattggaggacaatttggggtaagcattctctatttaacaagtcataattaactccctgccaaaactaagtagaaattgtgatttctataactcctatatttgataatatctcctaaaaatatttcagtgatatagcatttaattgcaaataattcatctagtcaccaaacaaatgtagggacgttcctatataccaggcactgtgcatatcaaggtgtatattacagtgaataacagaaacactcacgaagtgttcaattgaatttaaccttgaaatgtattatttattattattatgtttaaataaactatgtgaggtttttttttcattgccaatgagaaacccaccctaacttcagaatttttatctttaagtatatcctattttaaccacccttacccatccactctcaatgatttctcctcagtgtggggccttgccgtggaagtgtgccctggtcagtgagttttgagagtccgtggaagctagattgccctcggctcttcagttcccactgcagaactcttgcagtcactggctattggatcagcagaacctcttctattttcagtcgcccattttcaaattggctcactgaactttaggttctccagttttcaggtctttcaaaagtccgacacccctttactatcatctgctttctcctacacaggggctaatgccatgcaggttttgtgactgctggtggtgtgttcctacctgctttttttgggaggcttctgggcacagctggtcacctagtttcattataatcatttttaatggctttgctgttgttgtgttgctgtttagttctgtcagcttttatcctgggatttagagagacccaagagttctgtggccacataaccattgatcctgattcccctggagtctcttttgacttttactgcctaatttaagctgaacatatgaaatacatgaaaaaactgaaagctcaagctcgtttgttgtttgtcttcctaggttatggtttccatttctccctctttctcaacctattttgccaatcaatgtctatccttccttcactttttgcctactcactacaatattcaattacacaaacataatttttcctctgcccaccccagcaccagcatttttctgggagtttaagtctcttatgaatctgggaagaaaggaactaaaaatgagcagggatgaatagcaaaatgagtgagtcaacgagtagcaggcaggacattagagtgaagctgttttcttacccagaagactgatgatgggaaaggaaaaaagaacaattcaaaattagtagaagaaaagaaataattaataaaacatgagtggatattaatcaaatagaaattggacaaaaaatagtgaaaatgaacaaacgcaatagtttgtcctttgaaaaggttaataaagttgatgagcagaaaacacaaagtaccaacatcaaaaacacaaattaccaacatcagaaatttaaaaaagagacatcaatgtcgttgcacattttataaacattaaaaaattacagttttatgaacagctctgctaataaatctgatgtcctgaatgaaatgaacaaatgaacacaaaaccaacaacaaaaaatagaaatagcctcacatatattaaagacatttaattcatatctaaaaacctttcaacaaggaaaatctcagtcccaaatggcttcactaatgaatttgccactaacataaaggaataaataatattagtcctacacaaactctttcagaaaaccaaggaagggcatatatttctcagctcattttgtgagggctacctaactttaatcccataacctaacaaagcactaaaagaaaagcccattagaatattccatatgaacatagatgtaaaataccttaacagcatattagcaaatggaatcctgcaatatataatagggtaatgcatcatagctgattggatttctcccaggaatgcaaagttagtttaacatctgaaaatcagttaatgtagtaagccacataaatagaatacaaaagaattcccaggtaatcatctcaatagatcaaaaaactttgaaaaagaattcaaaacactttcatgataaataccctctgcctactaggaatacaagagaacttcctcaaactgaaaagggcatctgcaaaaaccctatagctaatattatgttaacaataaatgttaaattttttaccactacatcaggaacaaagcaaggaggtttgctcttataacttctactaaaaattgtaacagaagtctaaagtaggacaaaatgaaaaaacaaaaagccatgaatatcaagaaagaagtaagactattattatttgcagaaaatatgccactgtatagacagtgggagtataaaaattgcttggcaagcatcaagtcccccacatacaatcccctcctcacactactctccttcgtaaagccatgaaaaaccgctttatattctaagtaaggacgggatgtttgatgtgcaaatgcagctgtaagataaatccctgagcaacatttttggccaccctgcccttcctatagaaagtctggggctgtcactgaggtagggttagtaatggtatgtgagactggagagatatgtggaaaccacctcatggtatttggtcttcactagttaggcaatagggagctattgaatatttctgagcacaggagtgacacagaggtgtaccaagtaggtaagaggcagtggaaacaatctacctcagtggggaagagtattgtatcacaaaatttgtttagaattgctagtacttggtgataattaaaagcaaaacaattttaactgaatcttattattttaattttacttacagaaagtgcatcctcttttgtgtacccaggtgtttcattctcaccaccttaccgtaggattattatcatcagaattaaagtagatgaggcaaggcacagtggctcatgcctgtaatcctagcactttgggaggctgaggcgagaggactgcttaaggccaagagtttgagtttatggtaagctatgttcgtgccactgcactccagcctaggcagcagagtgagaccctgtctcttaaaaaaaaaaaaaaattggaatgaatgaaaattaattgatagcagtttattaaatggattagggagaggaacagactggtagatatcattcagtatacaatagctggttagtgatggcaattctgaaagaagaagtggtagaaactgggaggtgttgctagtgtagtatgacctttcaaaactcacagagtgcatagcttgtggatgtatagaacaatgtgaaagaataaattctccagaaaggaagaagaggagttagagattttataaaagagaagtctatgatgttctctaggaaagaaaagaattttctgaagaatatatgcattgattaaatgatttccttttgccctcatttatatttattttctgttcaaatgaaacacttaaactaacactcaatttccgggacagatttcctgttcttacattcttcaatttgctttttaaatttttactttgtttagcaatatcaacattgcctcattggcttttagtgagtttcttgagaagatgtaatctatagaacattagttcttctctcccaccagacagatgagtgcatagaaagacatatagttatactgctgctgttttaaaagtgttgcttcaaattacctaaaatatagtgactattagataatcactgataaaaactgtgttcatctaatttattcatcttgaaatcatgcttcatatttcctttaagcacaaaatagttatgttcacacatgcacaataaatcatatatggattacttgatgccttgaattcaccctcatagaattttatctcctaatgtaaagaaaactgactggggtaattattgcaggatcttactcttttctgttgtcagtaaccttcccaccaaactcattgtgacaattgtcacccggttgactgtgcatatccaccattgctccagagcctaggccagcagacttttgctgcatggtccaaaatggtgaggtcctgggtgtgatcacaaggcaatatgcagcaaacattagtgaccatcagtgctaacaaagaaacttacaaagtaacaacttgaccacttggccaattcttccactgtgttttcagctcttcacaggtgtaggccatgccttaaacttaattgagtctagcactcttcctgttactattattatatttgtagcttatgataagcagagtgaatttaacataggggttatgatcatgcatttgagagttgggccacttagtaactgtattagtccgttttcacactgctgataaagacatacctgagactgggtaatttatacaggaaaaatttatacaggacttacagttccacatggctggggaggcctcacgatcatggcagaaggcaaagaggagtaagtcacatcttgtatgggtggcagcaagcaaagagagagcttgtgcaggggaactcttgtttttaaaaccatcagatctcgtgagatttattcactatcatgagaacagcacaagaaagacctgctcccatgattcaattatttcccactgggtctccccccacaacacataggaattcaagatgagatttgggtgaggacacagccaaaccctattggtaactgcaccacctttaataagtaatttgatctttctaaggtttaaattcttcttctgtcaaatgaagattcatgtattttcacaaataataaaatgacgaaaattcctgccactatggagcttacattgtaaagtgatttggggagttggaagagaaagaacaatcaataaatataaaaataagtaagtttatttactaagttaaatgctataggagaaaactagacaaagtaaaatgccttgagagtaccatattaaggaaaggaattgcagttttggaaatgtagccaagagacttttaattgaaaagatggcatttcacttgagacctgaaggagatgaaggagttagtcatgtggaaatctggaagaagagacctaggcagaggcagcagcctatgcaaacaccataaggtggaagcacccctgatgtattcagaaaaggggctgtatagctgaagtgagcagaagaaagagtaggaatgtcccaagcctacgggatccttgtgcaagctgcaaataattggtcctttcactttgcaagtactgccccacatccatcaaatactttagaaggtttgaaaaaagtttgactatcaatcacttgatgaattttcctgcccactatttgctctataccagtgtgaaatgtacagagtaatacttccacttcatctttaccgagcacttactatgttccagagatgatgctaaacatgtttacattaataatctcagttaatcctgacaacagacctatgaggtagatattattatgctcattttattgataaatacgtgaagacttcagtagatttaagttgttcagagtatagttaattctgtggctagtaattgtggcacataatcctaatgttccaggaatttatatcatttagttgaggagacactcctcaactcctgtctcaggtgacaggagtaagtgaaattctaaggcacaatatagcatggtgcataagcaggcaggactgcagccacagaaccctcaattttaattcaggctaagtcacttactttcccttttatgttagagacgtctgttagtttttctacaggaagtataatacctcacagggtaatttattcacaaatacgaaaacatgtataaaacatcatagcagtctgcctgcaatatcgtaagtgttcaaaagggttgtggatattattattgttgttgtaagctaaggaacgctagaaaaacatcaaagattcaattactcaaaataacttttgctgagcatctactacatgtaaaatatgtatactgtgggatcaatggatgatgtaaaggtgcaaaaggttctggcccttggggagtgtatggtacactgggaagttatattttcagacaagacataataattctaatacaagctagaccttaaggaattgaatgacagaggtaacaagaaaatgctgtaaaatggctgaggagagaaaaatcctctaatttgggaggagctcagtattgacaaaggctagaaatgggtagagaacactttcccaaaagagatgtcgtggtgcctggtgagacaggctgtgaacttgacttctcccatccgttccattattaatgtgtgtctctgtgctctagcattcatttcatcttgtggacatgctattgtttccatttaaaaactctcttgatcacaatttcttctgtggcgatggtctcatgtcctgctctcctttttggcaaaactccttaaaagacttgtctaggctcatgcctccaaatcctattctgctattatttcctggaaatatatctgtcaggccttcactctcatcattactttgcaacttttcttgttaaggtctccaaggacctctgtctttttaaacaaagctaaattctgtcttcattgtatttgacatacaagcaggatttgacacagttgatcactctcttttcatttagaggactccacattctccgggttttcctcccatatccctgactatttcttctgtatcctttttctgtgccctcctcttacctttgaacacttattgttggagtgctctggaactctctttagaggactttcctgtatctacgctcacgcccttggtgatattttacttcaaataccaattatacacagacaatactcaaatgaatttcacaatcatatttccaattaaacacttaacatgttttatatatatatataaaatattatttgaatttaattatctttatcttcacatcaatacataataatctatcagcaaatcatgttggttctattttcaaaaatatccatagtctttcattcttcctagattcaataattcctttgcttgtctatttagttttctatatgtcattaatcttcctcatgctgacgtctttgctacatgaatatatacatatatatggtacacatacatatatattttatgcacacacacatacatatttatgctcaaggacctcctgccctgctatcagcctagagcttttcatatacctctacatcctcatttcctgaatcccatgccttccattcttgttgctgttgtctgtttactttctttttgctggaactatattactcaatagcttcctgatataggaagttaaagttttgaatccttgcaaatccagaaaatgtttgtattctttctttacaggcaaccgataatataacttagcatagaattctggattagaaataactttactcataatttggaaggtaccattcttagctttttagtttactataatgttgcagaatactgcagtgatattctgtattttctatgtgacttattttattggtctctggaaatttttgtttcctttttatttttggaatttgaatgcttcatgagattgcaccttgatctgggtttttccaccagcatgtggtgagccttttttttaactttttaatattttatttttaatcaatcaacacataatatttatacctattatgggatacagagagatatttcaatacatatgtaaaatgtgtgagtatcaaatcagtgtaattagcaaatccattaccaccaacctgtatcatttctttgtgttgggaacattcaaaatcctttcttctagctatttgaaaacatataataaattgttgttaactatagtcaccatacagtactataaaacacaggaatttattcttcttacctatctgtgattttgtatctgttaaccagcctctccctatccccttctccctgctatccttccaagactccagtaaccactattcgaccttctactttcatgagatcaactggtttagcttccacatatgagtcagaacaggtaatatttatctttctgtgccaggcttatttcacttaacataatgtcttccgggctaaacataatgccctctaggctaatccatgttgcttcaaaagacagagttttattccttttcatggctgaatagtatttcattatatatttatatatgtgatatatgatatatatatatatatcaaattttctttatctattcctttgctaatgagcacttaggttgattctatatcttagctattgtaaatagtactgcaataaacatgggagtgcagatatctcttcaacgtactgatttcaaaacgtctggatatatgtacccagtagtgggattgctgaatcatatggtagttctctttttagtttttttaagtgaccttcatacttttttccataatggtatgctaatttacattcctaccaacagtgtataagaattcccttttctctgcatccttgtaagcatttgttattttttgtcatttttataacatattttaactgggaaaagataatattgtggcttttgtttgcatttgtctgatgattagcaatgttgagcattttttcgtgtacttgttggctatttgtatgtcttcttttgagaaatgtctgtccagaccatttgcacctgttttaattggattatttggggccattgagttgattttcttatatattctaggtattaaacatttcttggatgaataccttgcaagtatttttccattctgtaggtcgtctctccactttgttggtagtttcttttgctgcgaaagggcattttagtttgatgtaattccatttgcccagaccaatgtcctgaagcacgtctcctaggtttacttctagtattttcatagttttgggtcttacgttgaagagtttagtccattttgagtggatttttgtatatggtgagagacgggggtctattttcattcatttgcacatggatagccagtttccccagcaccatttattgaagaggatgtccttttcccactctttgtttttggtgactttgttgaaaacccgttggcagtaaataggtggatttatttctgggttctctattctgttccattggtttctgtgtctgttttacgacagtatcatgctgtatagctttgtagtaaattttgcagttaagtagtatgatatcctcagtcttgctctttttgaacaggtgactttgtctcaagattgatttgtctagctcagtggggtggctcacgcctgtaatcccagcactttgggaggctgagttggacagatcacttgaagtcaggagttcgagaccagcctgaccaacatggcgaaagactgtctctactaaaaattcaaaaattagcagagcatggtggcgggcacctgtaatctcagctactcaggaggctgaggcaggagaactacttgaacccaggaggtggaggttgcagtgagccaagactgtgccattgcactccagcctgggtgacagagagagaccccacctcaaaaaaaaaaaaattgctttgtctattctgggtctttatggttccatgggaatttaaagaattttttcttctatttctgtgaagaatatcattagtattttgataggaatcatattgaatctgtagattgcttttgataatacagtcatttttataatattagttcctctaatccatgatcatgggatgcctttccattttcttatgtgtcctctttaatttctattataagttttatagttttccttgtacagaacttttaccctttggttacatttattcctcagtatttttgtttttttagctatcgtaagtgagatttcatttttacctagtttgtgcttgttgtataggaatgctactaatttttatatattgatttgatatcctgcaactttattcgtttagtttatcacttctaagagttttttggtggagtgcttagtttttattacatataagatcctgtcatctgtaaaccagaactagttgacttcctcctctccaatttgtattcctgttatttctgtctcttgcctaattgctctggctaggaatttctagttctaggttgaataaagagtagtgaaagtgggcatcaccatcatgttccagttcctagaagaaaagttttcaccttttctccgtttaataagatgttggttgtaggtttgtcatatatggcctttattattgaggtacatttcttccatactaatttgctgacagtttttagcataaagggatgttgaatttcatcaaatgctgtttctgtcttttgagatggtcatatggtttgtccttcattctgttgatatacttttatttatcccatttattcaatttgctcatattgaatcattcctacatccttggtataaatcacacttgatcctggtatgtaatatttttgatgtgctgttggattcggtctgccagtattttattgatgatctttgcaactatggtcatcaggaatattggcctgtagtttttgctgttgcatatttggttttgctatcagggtaatgctggccttataaaattagtttagaagaatttcctctccttcaattttttggaatagtttaagaaaaaatggtattagttcttctattaaagtttggtagatttcagcagtgaagccattgatcctggacttttctttgttgggagactcttaattactgaatcaatctcattacttgtgagtgttctgttcagtgttctattcctccttggttcaattttggccagttgtatgtatccacaaatttatccatttcttctaggtttttcaatttgttggcatatagttattcataatagtctccaatgatcaactgtatttttgtggtttcagttgtagtgtctcctttttcatttctgattttatttgagtcttttttctttttttctcagtctagctaatggtttgtcaatattatctttcaaaatatcaactttttgttttgttgagcttttgtattgtttttggtctcaattttatatccttcttctctgatcttttttatttctatattgtgccttgcagaggacctttctagttaaatacatttgggaacttttgagcttcctggatctgggtatctatgtctgtcccaagacttaggaagttttaagttagtatttcattaataagtttttattaccctttttgtcatcttgtctttctaagctcccacagtatgaatagctgtttgcttaatggtgtcccacaagtcctgtaggctttctttattctttcttattctgttttctttttctttctgtctgcttgagttatttcaatagacctgtctttgagttcataaatcatttttttctgcttgatctagcctgttgtcaaaactcttgattgtatttttatttcattaactaaattgctcagctccaatatttctgtttggttcatttttatgataccaatttcttgttgaatttctgatttagatcatgaattcttttcctgatttttttcagttgcatatctgtattttcttctatcttgctgagtttccttaacatcattattttgaactccttttctggcattttgaaaatctcttttactttggggtctgttactagaggattattgtgttcctttggtagtgtcatgttttcttgctttttcatgtttcttgtgttcctacattgatacctgcacatctggtaaagtaattgcttcttttaatgttatggactagcgcttatagggaaagatttactcctgtagataagttctagagtgttaagtagagggtgataacttgggtcctgagtgggcacagtagtgtagtctctgtgaagtttcttcaactgtaatccatgtcagtaatgtttgtgaatgcttcactgacctaacctgtgggagtttgtggcagcagtgacatgactttactggaatcaggcttattgagtgagttatcaggatggaggcatgtttgtgcatgtgatgggtcacctagcttaggaactggcttgctttgggtgaagccgtgggctgtttctcaggccgggggcatgagtgttcagtggatcagctggttctggaactggttcaccaggagtgaggctgttgggtcgtttctcagtttaggggcataggcacatgttggtttgccagccattaagccttttaaaactatggtttcatgtctggaaaatgtgtattttatactaattctttattaacttattcctttaattttttttccttttggtgtatttctgaaaatttgttttcatctcattattattgttagcctttctgatgtattttcttatctttctcttctaatcttttagttgagatttttttccagcctttttttttttttttggatatagaatcttagtatattgtctaggctggactcaaactcctgggctctaacaatacttctacctaagcctcctgagtagctgggactacaagcacatgccactatgcctggctgtatatttttaatatttaagaattctttctttcaccaattgtttattcttttaggcttttttttgtttctatattttttaatgaatgcaacttttatcttctggggataacagagatattttattaaattgttattagttgatgatttcttccatctctaattccctgcattgtttgtttcctcatctggattatcatttttcatcctcctcctttatttttgtttctgtcattcacattgtatattttgcacatttgatgaattttgccatctgctttattctgtagagaaatggtaaaacatttccaaaatggcctttactcatgtttatgagcagcaatacagctttactttgcagaggttaaaagctcaaatattagttctagagttcttatctttgtagtatttttctgccagtttcctctttatggaaaataactctggctcccggctttctttaaactgtgtagaaggggagttgtggtggtaaaggggagaggcagtgtatacagactttcacttaatcctttcatgtctaccttgtgcctcttccaataacaagttgttgatgttccaatataatggagctggttaatttcaattattcttgacaataagactgatgtcactgtggagtaggattagtttggctggctgagtggggttgaaaaggggacctgaaaatctaaatactttctatgtggaatacctctaattcatgattctcaaccttggcactatggctattctgggctgggtaatttgttgtgagggatggatatgtgcattgcaggatgtttagcagaatccctggctacatatcagtatactacatgccagtagaactcctcccctcactgggacaaccagaaagttcctctggggacaaaatcttccttagctgagaaccattgtttaactttagacctgtgtgtgtcctcttacttctctcaatgtttcattatcttcaagtcttaaggctctcaaagattctataggaaaaatcagttttcatgttttaggaatccaattcagctagcactcaagctgtaacttctctgattattcaagaatgttgtcaatatttatttctatttcttaatttcattttctgtcttcaaaatttttgtaaaatgtatttcttccctattgatttctctgctggcctcattaaaattatgggttatattttttaaaattcctatttttttaattgaagtatcaagaaaaagaggaaaaggcacatgcttgatctgaactttatcaaaaattggtaattgttttcatctcttactattaactcttttttaaatcgatcctcttgctttaggaatccaaatcagcctgcactcgtactgcagtttctctgattagtcaagaacgttgccaatatttatttatatttcttcatttcatttttcgtctttgaaatttttgaaaaatatatttctccattattgttttctctgctggtctcattaaaattatgggttttacttgttaaaattgctgttattttaaagtagtgagaaaaagaggaaaatacatgtgcttaatctaaattttaccaaaaattttatattttagtaaatgtattcagatgcatatttttctgacaatgggcagtcttagttaacacctgtatcctttttcttgagcaagaaaataaatttattataatttttacttattctgccctagtattcctcatggataaatcgtgtcttaattttattaatctttgaatgcatcaattctaataagttggatcctttgtcagaaagcagaatgtgtacaatatacttatcccttagttttgtcttcctgggaactggctcttgatcacaataggatatatacctacagatcagcttcattataatttaatttactgtatttggcagcaacatcttctagtggtaacctagaccgagatgaaatattccatttcaattgacagttataaagctacagaccatagatttcagttatttgagtagttactacattaaaacacatctttttttcccttcctttgctcccaaccacatgtgcagcaaccagtatgtttctaaattttgctcctgtttataatgctatttcttaagcttctaaacatcgcagtgtgcatttcacctctgctaatctccatccaaattctgctatgttttggagtttgtaagaaagtgtagtgctgatgaggggattgaagtttcaggattccaattttggctgcttaacaggaacagttgaaggatggcatgaggtttttgatccatggttttccatttccctggtatagtaagcataggtatcactgccaaacttctttggagctctatgttatttgggttgagagcttggagctatgttaaacagctgaataaatgtttcccaatgcagctctgtctatgatgcagctcctgaaaattctctctgaatgttgtcaactagttttctcttaaattgagtttatagttgttttgtcaggtccaaatgtctttttgagactttactttgactgaacattgtgatagaatttatcctcctgcttgaaatgataaaaatatggacaaaatgtattaaataattgtttgctagatgttggacatcaggcaatgaggacaatgtttgctgagaaataggaaataaattatgtgaatcttacaattgacccggattactgcttacagagtatttctagaccacgacttagggagagaaatcccagatggagctcagagagttctccaaattgaagagatatagccaagtgtttcaggaattcaaagtagttagagtttgcagagagcagatagaggaacacagagataatttcacagatctacagagcatcttccttaagaattcactttactacggttcactgcatgtatgaggctgcagaaagcacaactttcaattattaaaagtaacaataattaacactcatgtaatgctgggtatgtgcctatttccactagctgaactggcgagaaaatttatgattcgtgggatatttgataagagtacacaaaagggtctagcctcaacagtggagaatagccctaggctgataactacttcaataccacctaataaatcttaagagcaagactcaaaaggaactgtttccaagtaatttaactgcatccaagaacaaaacacaaatatatttgtaagaacactgaaatatgtagtacctaacaagaaaaaattcacagtctctggcaccaaatcaaagattatcaggcatgtaaagaagcaggaaagtacaacttataatgaggatgtaaatgcatcaatcaaaattgatccagaattgtgagaaatgttagaattatcaggccagtatgttgaaacagatattacaactctacatagtttaaaagctacataaaaatatggaaggtactaaataaccccacagatcaaaattccagagaaaaacctacactgtatggaatgaaaatacactggatataattgattatacattaaacataaaacatttatgttatatataaaaaattagtgaacttgaagtcatagcaatataacctatccaaaatgaaacagagttgaaagagcatttgtaaaaatgaaaacagcatttgtgagctgtgggacaacttttagaggcttggtatatgtgtaattggagtccctaaaggaatggtggggtggaggtgggaatataaaaaatattcaaataatttatggctgaaaaattccaagtacagtacactgaaaaccataaagccacaaacccatgaatctcaagaaaactaaaaaataagtaacatgaaggaaatcacaaaaggcatattataattgaattgctcaaagctagtgataaatttttaatgataaaataaaatactacagcagccagaggaaaaagacgtgttaaatacaaaggcaaaacagtaagaatgacaacagatttcctatccaaaataatgcaaagaagaagacagtggggcaacattcttataactatgaaagaaaataaatagtgcacttatgattctatatctagtaaagatatctaagatgaaggtgaaataaaaactatttgcaatacatataatgaaagagttcatcacacagaaacctatactataagacacattaaaaagaagtccttcagtaggaaataaaatggtatcatatggaaatatggatctgcacaaagaaacaaagagcacccaaaatggcaactgcattggtaaatacggagggtatttttctaatgatttaattttctttaaatatagttgacagtttaaaaaataataataatatagtaaaagttttataacatgtgtaagtaaaatgtttggcagtaataacacaataattaagagggggaaaaggaagtacccttgacccttgaacgacatgggagttaggggcactgattccctgcacagtcaaaaattcaagtttaattttgactctccaaaagcttaactactaatggcctaccattgaccaaaaaccttactgataacatgaacagtcaattaacatttattttgtatatattatttactgtattcttaccataaagtaatctagagaaaagagaatctttaggacaatcataagaaagagaaaatgtatttactatttgttaagtgaaagtggatcataaagatctttgtcctctttatcttcactttgagtaagatgaggaggaggaataagaggaagaggagagattggtcttgtggcctcatggctggcagaggtggaagaagattcttttataagtagactcatgcagtgataacccatgttgttcaagggacaattgtataccgttgtaagatccttatactctatttgaagtagtctgtcacttaaagctaggctgtgataaagatgtaggataaaaaccactaaaatcataaaacaaagagttataactaataaaccaacatggagataatttgaatcataaagaaatataaaataacacaaaacaggcaaaaaaaaaaaaaaggaaaaaagaaatcccaagcagatgggacaaataggaaatatcaagataatagatttaaacataatcatatcaataataatgctaaatttacatattctaaatactccacttaaaatatacagattggaagattggttaaaaaaggaaaaagtacaacttaactatatgctgcttacagaaaagatatttaagtataagacacaactaggttaaaagtaaatgttggaaaagataaatcttgtgaacactaatcataagaaatctagggtgactttattaatatgagaaaacatgaatttttagaaattttgtccaagataaaatattgcccaggatgaagaaagtaatttcattttgcaaaaggagtcattttgtcaataggacataacaattcttaatatttctgtaccaacagcagagcttcaaaatgcacagagcaaaaactaacgtaactgaaggagaaagtaaaatccacatttgtcggcaaaaatttcaatacccttctctcaataattaatagaacaaactgacaggaaataagtaaatctatagattagaacaacactgtcaaccaacttgacccaatggccagttatggaacattcaacccaacagagcagcaaactacacctacttttcaggcctacacaaaacatctaccaaaataaatcaaattctgaaccataacacaagcctcaatagatttaaaagaattcaaatcatataaagtacattatggggctgcagttaaattaaattagaaatcaataacaaaataacctggaattactctaaatatttggaaactaactaacaaaattctaaataatccaagattagaagaggaaacccaaagaggaattaagaagtattttgaactgaatgaaaatgaaaacacagcataacaaaattgtgagatacccaatatggcaggacttagtagtatattaatagcactaaatgcctatgctaggaaaggatgaagatttcaaagaaatatcttctactttacaaaactagcaaaagaagggaagacccaagccaggctaatgaaagctatttctgagtttctaactgcatctcatggggatgatcatttcttttctctgctcttgtggctgaaagcatgttaaggccaaaattgtgattcaggcaagacccaaatttataagaccaagattgcattttaagccataaagagcaggagaatctccatggcttgaactgtgaatagatatttgtttgttatcagagatagtaattgtactgctttatctgtatttccttccatgttagtaaaagaaagctcagaagtagttgatcacatgatcatagagaataaactacatttctcagtctccttggcagctaggtgtagaaatgtggtttaagttctggtcaatgatattttatctattaacgtttgctgtttaagttagtggctaaaaacaataaaaattgcgtatttatttaggattctatggtttggctcagtgctggtgtgcactggcttgtccaacctcttctgggctctctcatttgtctgtgattagctagctggtcaagcagcagttagataggaagacctcactctcatatgtggtggttggcaagctggctgttcactgggacagtaggagcaattattagctggggcacctcagttctctgccatccaacctctaatattccagcaggatagcatgagcttgctcacaaggtgatctcagagttccaagcccagcaagaaagaatgaactctaaatttgcaggcattttaaattgtctgtttgaatcatatttgcaagcattatatgtgctagtatttggccgaagaaaaccaataggtcaatctagagttattgtggaaggatcgtaccaaagagtgtcttagtgtatttttaaaggaaaggggaatgcctttctctctttctacttcttggtggacagcaattggttttagagtatgagtagatttgtattttctcacattaaaaaggtagaatctacaactgtggaatctatagaagtaaactgggtattttcagttgaatcttgggaaactgactaaagttaacatttttaaaaataataatgctttattttatttttaaactacattttaagatatagttaatatacagaaattataatctatatgtgttacagagagattaatgaaatgggagtaaacttgttattttattaatttgtggcagagttcatatagaaagaattgtttttattgacaaaaatatctcgataagacttaggttttggcaagaatcaaggcaatattatacacttttgagatgtctgtgaaaaagtgaccatgtaaagtcaggtgtatagaaaaaagtgaatatgctttatagcagagcaaggaggaagaagagagaagccacagaagatggtagataattggagtgcaagatggtaggtaattggagtgccaatgaaaatctctagctatagggaaactaaagggatattatgaattgcaaagtaatgatttaattcctcttttaccccgaatctttaataaggtttaacgactacaatttgtttgtttgttttgaacaagacttcttgaaattgaggcattagctgagtttcacctctgggtgacatagggcagtgctggcagaagccagaaagacttcaaaatggaagaagcagaagtgtagggtcagggcgactacgaaatgatcaatacgcatagaattcttataaacttaaggaggacttctgtcattcagggatggaattagggtcataggctgccttatctagatttcaaaaggcaaggacgctccagatgatacatgcattacatgtaaataagaatacaacaaggccaggtgcagtggctcaggtctgtaatcccagcaatttgggaggccgaggcggacagatcacctgaggtcaggagttcaggaccagcctgaccaacatggtgaaactgtgtctctactaaaaagataaaaaattagccgtgcctggtggcccagctactggggaggctgaaacaagagagtcacttgaacctgggaggcggaggttgcagtgagccgagatcgcaccattgtactccaaatttgcaggcatttttaaatgtctgtttcaatcatttttcaagagttaaactccatctcaaaaaaaaaaaaaagaaaaaataacaaaacatataaaagataaaggttttgcacttttatttctctttaccttttgcacacttccttgctctttgaaaaagtattgtttacatgtaatgtttaagattattctttgacggaaacatcacatatgtccaatgccttaaggtgtttactatctctttggagaacaggactgatcctgtaaagtaccagcaaagactcaggcctgagttatgggttgatgtacttgaagtgttacaagtatgtacccacacgcctattggattttcatggtatgcctatatgttacacatatccaccaataaatgccatctatttttgtaggctgaatcaaatctctgtcttgagtaatgattttgtatcctttggactagatctgaataagactgagaaacagccaggcacaagaaggcaattcattgttctcactcatctttctaaacctatatgcatctttgatattgaggttcattattagctacaactacatttggtttgcatataaccatttatttttcagtcttagatattttcatatcaattgtcttaattatccttaaataaagcttccagtgagtctctatttcttggatgaggacaattgaggcagtgatagttctttaaaaattatttaatttctaagtccttcactatatcttgtaactgaatcccaacctagatatttttaaatatccttgaaattaaatataaatcaaataatatctttccacatgtaggttacttccctctatggtaactctgcctccaaatgtgaagagctggattcaatccaagtgaaagaaaatcagtggggaaaatgtcagggactataaaagagatttgaagtctgtacccacattgctgtgttagagtcctgagttattaaatttctcatatttatttgacattttatatacatatgtccacttatgaagagtttagttcttatctttctttaatcaacacagtattaactatgcatgtagtagatgaacactgtattttatgtatttgcattcttttcaaaccagatgcttaaagaataaaatgacacagtgttttagctgttattttgctttaaaatgctttaaaacaagaaacatttttggaatttcttatcacaatataaatcagctaagtatatttaatgtggtgaaatgaatcataaataggctgaaatagtcctaaaaggggagttgggtaagaaaaaaatgtattaggatcaatatcaataggcataaataattctattaacaaataacattaaacattgttacactgtttatgggatgatatcattatatcattatagaaagattctcccttaatttaaatacctagcatgtacaaaacaagtttaaatcaatgagacagtaaacaagaggaataaaatagagaggtgggctgggtgcagtgattcacgcctgtaatcccagcactttgggaggccgaggcgggcggatcacgaggtcaagagatcaagaccaatatggtgaaacctcgcctctgctaaaattacaaaaattagctgagcgtggtggcgggcgcctgtagtcccagctactcggaaggctgaggcaggagaatggtgtgaacccagaaggcggagcttgcagtgagccgagattgagccactgcactccagcctgggtgacagagcgagactccatctcaaaaaaaaaaaaaaaaaaaaaaaaaaggggaagtggtgtcctaaagactaaattaactgctgactattttctattttcagtctctacatatttatatttttatttctttatatagcattgaatggttaattccccatttcccttttattcttatacgactaacttctatgggttttattttcattcagttctgtatattccccctgctgaagcctcccatgttgtgtgtcaagaggaaaaatatcttattaccttcttgtctgttgaacatttagttttcttctccctccctccctgtcttgtacctaatgagcaaattatctaaaaatagatacgttcatcattctacaaaatgttgtatcttctctagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattggtacgtgtaacgcaaaagtttacagtcacatctctattaccatctggaataaaattctctatttgatttcttaactgaagagtaaagcaaatttctttgctcaagacaggctggaaaaaaaaacaatttggatgaaattaactgtttaaaatgattaaattaataattctatcaaactgcagcttgaagcttagtttaatcaaccctttagaagtttctttattctgtagatgcattaattcccatggtcccatactaataagtcatagaaaaatataatttgcttactgcatagatgtttcttttagaaaattagcactttttcaaaatgttttacacttaatgagttctaagcaaatcatttccatgctagttttcttaatagaccaaaataagtggattttttcaaaatattctgtgctacagggtcctttgtgataaatctttccatttttttctgttatatttctttgaactgttcctatgaaatgcaaaataagtcaacataattctacagatcatgtatattgctagggttacttacaaagggctacataattttaattttgtaattcagcaccaagttgattataataaacagctgccttcggtgttatttatcatttttttatacaagacgtgcttttttgtttgttactcccacaggtatttttcggaaattagatttgattatagcaatttattacatccaacatttttgaggggaaccaccgccacataaggacaaaatttatcaagtgcctaaaatgcactatgttcataatgcactttgaaattttgatatatgagaatattatgagaggaaagtttcctgatgaagtgagccctgtattgtaactgaatatgtcttggttcctataggaagtttaaaaaagacctttgcctttctattgtcattcaagacaccaagtcatccatggtttttctaacactgacctgaaccttacaatagtaaaaatatgcctggcagtgattacacacactcctctctctctctctctctcacacacacacacgaatgcttacatgtacacatgcatatgtacatatcattctgaatactattttcatttctgtgatatacctctaaatctaattctttatcttttatttatgtaagtgtacatcatgctacacaattcagctagacaagcgtttcaatttaataaagagaatgtaggtgtgtttagtggcattacacgagatttctctggtttaaagaaacattacatgaaaatctgtaccataatttacctatatgcatctcaagcatacagaaactaattttttagaaagaaagaataacgtgtaaagagaagtacatatttgtatgtgctatccatgatgctgaaggaattctaagaccctgaattcaatttgtatggcatcctttgttctttaatgtgagatatattttaaactcaagatgtgaaaacaaaagttaaagcaagacctttaaagacagtgaaataattacttctttgtatcaatggaatctttcttgtgatggttagattccagagcttgaggaagggaaaaatcaaaattaatttagaatgtataatgccatccctactatttgcctgttttgttgattgatccagatggttttctgcaggaaacataaatatatattttgtgaagactaaattacttcagtattataaataattattatttctagtgttatttctgcaaatgtagtactttttataaaaacaaaaacttgatatgcatatatatttactttcctaatgggatcagcaagtaactttattcaatttcaccttgttaatatgaaaaaaaaagaagcccagaaaatacaagtgtatgttgtatacgcttcagaaagcaaactgttagagttaacaaaactgttaaatcttactaatgattctatcaccagtaaaatacattagcaccaataattttattaaagtaggtcattcatctagaataaaaagggagaagaatgtgaattaaatgccaagtgtgctaactcgcctgtacttgttaacaccgaatgtgatgccctgtaggccttcctgactatcgttaggaatagattacctgtcaggaatatgtatggcatattcaaataagcactgtgcatatttttaaaactgatatgatatgaatccatgtagaccaattttaatagttcaaaatgagtcataattcttgttaacaatacagttatttttaaaatttgcagcaatagtggtccttttttattttccttattgaaattaaatgatatgccttaggtgagtcattcatcactgttaaagaacttgccttcattggagttcttgaatttttatccatatatatacatatatattatgtatttccttccagtttaggaaatgcttttctacatatgagttcctgagtatgtttttgactcttattttaagattaatttttaaattgcaattatagcttgaaataaatgtttcagttgattcaacccatgcagtgagttatttaaattcatggatatttggaaactatctaaaggaagtattttgcatctaaacatttactattctaatttttttatttctttgccttgtaatacccttttatcttttagaataaccttacttgtcagagatttaagtttaggtgataaaacatttttcttcattcgtaaaatgtatatgtgtactcctttaaatagaagtaatataaaaaacagaatttacttagtgtttaaagaggtatgttctgagtcacacaagatgacaagcaatgtgattgctttatgagccaaggagagcatgatttatattaattgaaaatgataaaatagaggagcatacaaaaggattaaaccaaaaattgccctggataagttttatttatattaattacttaaatgtgtggattcagaaataagtgtatatgctgttttcacaaaaatagttatcagctgacatttttttcttttttcccagcttcacgaaggtataattaaataaaaattgtatatatttatggcagacaacatgatgttttgatatatgtacacattataaaatgattaattccagctaattaatgtatccatcacctcatgtacttatcatgtttttggggtgagaacatttaagatctaatctcttagcaattttcaagtatacaatacattattattaagtatagtcaccatgctgtacaatagagctccagaacttattcattctgtctagctgaaactttgtactcagcttaaccttttattaaacatctttagagatttcttatctttagaaaaacaactaatttgttatatgtaattctactataattttaaatgagcacatttgttaaaatagtttttaagatttgttaaagagaaaaagagctccagcatatgtaacagaaacaacatttgcattaagcatttttctttgcattaagtaataattaaaaatttatgaagttcatcgcaaacagttgtatattaaagctaaattaaatattgtcattgaattttgagagtaagattggccccctatggcattgcttgtgagaaaacactcaatattttgtgttcgtatcatctgcagtagcattgtttgtgtctcgtctatcttgaatgaaatcattttcccatcctcaccttttaaatatattttatctttagggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccag

SEQ ID NO: 39 - DNA, 24 bp, Artificial Sequence
  Antisense ologonucleotide
ggtaatagagatgtgactgtaaac

SEQ ID NO: 40 - DNA, 44 bp, Artificial Sequence
  Sequence fragment
taacgcaaaagtttacagtcacatctctattaccatctggaata

SEQ ID NO: 41 - DNA, 34 bp, Artificial Sequence
  Sequence fragment
caaaagtttacagtcacatctctattaccatctg

SEQ ID NO: 42 - DNA, 4436 bp, Artificial Sequence
  AAV vector construct
  misc_feature (203)..(203): n is a, c, g, or t
caccgagtaaaagagtctgtccatcacgcaaattaaccgttgtcgcaatacttctttgattagtaataacatcacttgcctgagtagaagaactcaaactatcggccttgctggtaatatccagaacaatattaccgccagccattgcaacggaaaaacgctcatggaaatacctacattttgacgctcaatcgtctggaatnccattcgccattcaggctgcgcaactgttgggaagggcgatcggtgcgggcctcttcgctattacgccagctggcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagataacaacataggagctgtgattggctgttttcagccaatcagcactgactcatttgcatagcctttacaagcggtcacaaactcaagaaacgagcggttttaatagtcttttagaatattgtttatcgaaccgaataaggaactgtgctttgtgattcacatatcagtggaggggtgtggaaatggcaccttgatctcaccctcatcgaaagtggagttgatgtccttccctggctcgctacagacgcacttccgcaagtgtgattctggagaggaagctgaatttttggagcaggttttctgacttcggtcggaaaacccctcccaatttcactggtctacaatgaaagcaaaacagttctcttccccgctccccggtgtgtgagaggggctttgatccttctctggtttcctaggaaacgcgttgtggctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggacgattccaacatccaataaatcatacaggcaaggcaaagaattagcaaaattaagcaataaagcctcagagcataaagctaaatcggttgtaccaaaaacattatgaccctgtaatacttttgcgggagaagcctttatttcaacgcaaggataaaaatttttagaaccctcatatattttaaatgcaatgcctgagtaatgtgtaggtaaagattcaaacgggtgagaaaggccggagacagtcaaatcaccatcaatatgatattcaaccgttctagctgataaattcatgccggagagggtagctatttttgagaggtctctacaaaggctatcaggtcattgcctgagagtctggagcaaacaagagaatcgatgaacggtaatcgtaaaactagcatgtcaatcatatgtaccccggttgataatcagaaaagccccaaaaacaggaagattgtataagcaaatatttaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtactatggttgctttgacgagcacgtataacgtgctttcctcgttagaatcagagcgggagctaaacaggaggccgattaaagggattttagacaggaacggtacgccagaatcctgagaagtgtttttataatcagtgaggc

SEQ ID NO: 43 - DNA, 4433 bp, Artificial Sequence
  AAV vector construct
  misc_feature (203)..(203): n is a, c, g, or t
caccgagtaaaagagtctgtccatcacgcaaattaaccgttgtcgcaatacttctttgattagtaataacatcacttgcctgagtagaagaactcaaactatcggccttgctggtaatatccagaacaatattaccgccagccattgcaacggaaaaacgctcatggaaatacctacattttgacgctcaatcgtctggaatnccattcgccattcaggctgcgcaactgttgggaagggcgatcggtgcgggcctcttcgctattacgccagctggcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagataacaacataggagctgtgattggctgttttcagccaatcagcactgactcatttgcatagcctttacaagcggtcacaaactcaagaaacgagcggttttaatagtcttttagaatattgtttatcgaaccgaataaggaactgtgctttgtgattcacatatcagtggaggggtgtggaaatggcaccttgatctcaccctcatcgaaagtggagttgatgtccttccctggctcgctacagacgcacttccgcaacccttaaaagccagcatacaaatttttggagcaggttttctgacttcggtcggaaaacccctcccaatttcactggtctacaatgaaagcaaaacagttctcttccccgctccccggtgtgtgagaggggctttgatccttctctggtttcctaggaaacgcgttgtggctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggacgattccaacatccaataaatcatacaggcaaggcaaagaattagcaaaattaagcaataaagcctcagagcataaagctaaatcggttgtaccaaaaacattatgaccctgtaatacttttgcgggagaagcctttatttcaacgcaaggataaaaatttttagaaccctcatatattttaaatgcaatgcctgagtaatgtgtaggtaaagattcaaacgggtgagaaaggccggagacagtcaaatcaccatcaatatgatattcaaccgttctagctgataaattcatgccggagagggtagctatttttgagaggtctctacaaaggctatcaggtcattgcctgagagtctggagcaaacaagagaatcgatgaacggtaatcgtaaaactagcatgtcaatcatatgtaccccggttgataatcagaaaagccccaaaaacaggaagattgtataagcaaatatttaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtactatggttgctttgacgagcacgtataacgtgctttcctcgttagaatcagagcgggagctaaacaggaggccgattaaagggattttagacaggaacggtacgccagaatcctgagaagtgtttttataatcagtgaggc

SEQ ID NO: 44 - DNA, 4433 bp, Artificial Sequence
  AAV vector construct
  misc_feature (203)..(203): n is a, c, g, or t
caccgagtaaaagagtctgtccatcacgcaaattaaccgttgtcgcaatacttctttgattagtaataacatcacttgcctgagtagaagaactcaaactatcggccttgctggtaatatccagaacaatattaccgccagccattgcaacggaaaaacgctcatggaaatacctacattttgacgctcaatcgtctggaatnccattcgccattcaggctgcgcaactgttgggaagggcgatcggtgcgggcctcttcgctattacgccagctggcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctagataacaacataggagctgtgattggctgttttcagccaatcagcactgactcatttgcatagcctttacaagcggtcacaaactcaagaaacgagcggttttaatagtcttttagaatattgtttatcgaaccgaataaggaactgtgctttgtgattcacatatcagtggaggggtgtggaaatggcaccttgatctcaccctcatcgaaagtggagttgatgtccttccctggctcgctacagacgcacttccgcaatgtatgctggcttttaagggaatttttggagcaggttttctgacttcggtcggaaaacccctcccaatttcactggtctacaatgaaagcaaaacagttctcttccccgctccccggtgtgtgagaggggctttgatccttctctggtttcctaggaaacgcgttgtggctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggacgattccaacatccaataaatcatacaggcaaggcaaagaattagcaaaattaagcaataaagcctcagagcataaagctaaatcggttgtaccaaaaacattatgaccctgtaatacttttgcgggagaagcctttatttcaacgcaaggataaaaatttttagaaccctcatatattttaaatgcaatgcctgagtaatgtgtaggtaaagattcaaacgggtgagaaaggccggagacagtcaaatcaccatcaatatgatattcaaccgttctagctgataaattcatgccggagagggtagctatttttgagaggtctctacaaaggctatcaggtcattgcctgagagtctggagcaaacaagagaatcgatgaacggtaatcgtaaaactagcatgtcaatcatatgtaccccggttgataatcagaaaagccccaaaaacaggaagattgtataagcaaatatttaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtactatggttgctttgacgagcacgtataacgtgctttcctcgttagaatcagagcgggagctaaacaggaggccgattaaagggattttagacaggaacggtacgccagaatcctgagaagtgtttttataatcagtgaggc

SEQ ID NO: 45 - DNA, 29 bp, Artificial Sequence
  PCR primer
gggtctagataacaacataggagctgtga

SEQ ID NO: 46 - DNA, 28 bp, Artificial Sequence
  PCR primer
aaagctagccacaacgcgtttcctagga

SEQ ID NO: 47 - DNA, 43 bp, Artificial Sequence
  PCR primer
cagcttcctctccagaatcacacttgcggaagtgcgtctgtag

SEQ ID NO: 48 - DNA, 43 bp, Artificial Sequence
  PCR primer
gtgtgattctggagaggaagctgaatttttggagcaggttttc

SEQ ID NO: 49 - DNA, 40 bp, Artificial Sequence
  PCR primer
tgtatgctggcttttaagggttgcggaagtgcgtctgtag

SEQ ID NO: 50 - DNA, 40 bp, Artificial Sequence
  PCR primer
cccttaaaagccagcatacaaatttttggagcaggttttc

SEQ ID NO: 51 - DNA, 40 bp, Artificial Sequence
  PCR primer
cccttaaaagccagcatacattgcggaagtgcgtctgtag

SEQ ID NO: 52 - DNA, 40 bp, Artificial Sequence
  PCR primer
tgtatgctggcttttaagggaatttttggagcaggttttc

What is claimed is:

1. An exon skipping antisense oligonucleotide or an exon 12 retention antisense oligonucleotide that binds to and/or is complementary to a polynucleotide with the nucleotide sequence as shown in SEQ ID NO:12, SEQ ID NO:13, or SEQ ID NO:14, wherein the antisense oligonucleotide has a length of 20 to 24 nucleotides, wherein the antisense oligonucleotide comprises a 2'-O-methoxyethyl modified ribose, and/or wherein the antisense oligonucleotide comprises a 2'-O-alkyl modified ribose such as a 2'-O-methyl modified ribose, a 2'-O-ethyl modified ribose or a 2'-O-propyl modified ribose, and/or substituted derivatives of these modifications such as halogenated derivatives, and wherein said antisense oligonucleotide comprises or consists of a sequence selected from the group consisting of SEQ ID NO: 10, SEQ ID NO: 11, SEQ ID NO: 15, SEQ ID NO: 16, SEQ ID NO: 17, SEQ ID NO: 18 and SEQ ID NO: 39.

2. A pharmaceutical composition comprising an exon skipping antisense oligonucleotide or an exon 12 retention antisense oligonucleotide according to claim 1 and a pharmaceutically acceptable excipient.

3. The pharmaceutical composition according to claim 2, wherein the pharmaceutical composition is for intravitreal administration and is dosed in an amount ranged from 0.05 mg and 5 mg of total exon skipping and/or exon retention antisense oligonucleotides per eye.

4. The pharmaceutical composition according to claim 2, wherein the pharmaceutical composition is for intravitreal administration and is dosed in an amount ranged from 0.1 and 1 mg of total exon skipping and/or exon retention molecules per eye, such as about 0.1, 0.2, 0.3, 0.4, 0.5, 0.6, 0.7, 0.8, 0.9 or 1.0 mg of total exon skipping and/or exon retention antisense oligonucleotides per eye.

5. A method for modulating splicing of USH2A in a cell, said method comprising contacting said cell with an exon skipping antisense oligonucleotide or an exon 12 retention antisense oligonucleotide as defined in claim 1 or the pharmaceutical composition according to claim 2.

6. A method for the treatment of a USH2A related disease or condition requiring modulating splicing of Usher of an individual in need thereof, said method comprising contacting a cell of said individual with an exon skipping antisense oligonucleotide or an exon 12 retention antisense oligonucleotide as defined in claim 1 or the pharmaceutical composition according to claim 2.

7. The method according to claim 6, wherein the USH2A related disease or condition is Usher Syndrome Type 2.

\* \* \* \* \*